US012606629B2

(12) United States Patent
Li et al.

(10) Patent No.: US 12,606,629 B2
(45) Date of Patent: Apr. 21, 2026

(54) MONOSPECIFIC ANTI-FRIZZLED ANTIBODIES AND METHODS OF USE

(71) Applicant: Surrozen Operating, Inc., South San Francisco, CA (US)

(72) Inventors: Yang Li, Mountain View, CA (US); Thomas Steven Lopez, Palo Alto, CA (US); I-Chieh Wang, San Bruno, CA (US); Parthasarathy Sampathkumar, Foster City, CA (US)

(73) Assignee: Surrozen Operating, Inc., South San Francisco, CA (US)

( * ) Notice: Subject to any disclaimer, the term of this patent is extended or adjusted under 35 U.S.C. 154(b) by 1146 days.

(21) Appl. No.: 17/623,006

(22) PCT Filed: Jul. 2, 2020

(86) PCT No.: PCT/US2020/040736
§ 371 (c)(1),
(2) Date: Dec. 27, 2021

(87) PCT Pub. No.: WO2021/003416
PCT Pub. Date: Jan. 7, 2021

(65) Prior Publication Data
US 2022/0275095 A1 Sep. 1, 2022

Related U.S. Application Data

(60) Provisional application No. 62/875,073, filed on Jul. 17, 2019, provisional application No. 62/869,976, filed on Jul. 2, 2019.

(51) Int. Cl.
*C07K 16/28* (2006.01)

(52) U.S. Cl.
CPC .......... *C07K 16/2863* (2013.01); *C07K 16/28* (2013.01); *C07K 2317/31* (2013.01); *C07K 2317/33* (2013.01); *C07K 2317/52* (2013.01); *C07K 2317/55* (2013.01); *C07K 2317/569* (2013.01); *C07K 2317/64* (2013.01); *C07K 2317/71* (2013.01); *C07K 2317/75* (2013.01)

(58) Field of Classification Search
CPC ............... C07K 16/2863; C07K 16/28; C07K 2317/31; C07K 2317/33; C07K 2317/52; C07K 2317/55; C07K 2317/569; C07K 2317/64; C07K 2317/71; C07K 2317/75; C07K 2299/00; C07K 2317/92; C07K 2319/00; A61K 38/00
See application file for complete search history.

(56) References Cited

U.S. PATENT DOCUMENTS

| | | | |
|---|---|---|---|
| 11,142,577 B2 | 10/2021 | Garcia et al. | |
| 12,006,368 B2 * | 6/2024 | Li ...................... | C07K 16/2863 |
| 2010/0254979 A1 | 10/2010 | Staunton et al. | |
| 2017/0306029 A1 | 10/2017 | Garcia et al. | |
| 2017/0349659 A1 | 12/2017 | Garcia et al. | |
| 2020/0199237 A1 | 6/2020 | Garcia et al. | |
| 2020/0199238 A1 | 6/2020 | Garcia et al. | |
| 2020/0308287 A1 | 10/2020 | Li et al. | |
| 2021/0087280 A1 | 3/2021 | Li et al. | |
| 2021/0292422 A1 * | 9/2021 | Li ...................... | C07K 16/2863 |
| 2021/0403578 A1 | 12/2021 | Garcia et al. | |
| 2022/0195053 A1 * | 6/2022 | Li ...................... | C07K 16/2863 |
| 2023/0183359 A1 | 6/2023 | Garcia et al. | |
| 2025/0051459 A1 * | 2/2025 | Li .......................... | C07K 16/28 |

FOREIGN PATENT DOCUMENTS

| | | | |
|---|---|---|---|
| WO | WO-2010054010 A1 | 5/2010 | |
| WO | WO-2016040895 A1 | 3/2016 | |
| WO | WO-2019126398 A1 | 6/2019 | |
| WO | WO-2019126399 A1 * | 6/2019 | .............. A61P 19/08 |
| WO | WO-2019126401 A1 | 6/2019 | |
| WO | WO-2021003416 A1 | 1/2021 | |

OTHER PUBLICATIONS

Gurney A, et al. Wnt pathway inhibition via the targeting of Frizzled receptors results in decreased growth and tumorigenicity of human tumors. Proc Natl Acad Sci U S A. Jul. 17, 2012;109(29):11717-22. doi: 10.1073/pnas.1120068109. Epub Jul. 2, 2012. PMID: 22753465; PMCID: PMC3406803. (Year: 2012).*

International Preliminary Report on Patentability for International Application No. PCT/US2020/040736 dated Jan. 13, 2022, 9 pages.

International Search Report and Written Opinion for International Application No. PCT/US2020/040736 dated Dec. 8, 2020, 12 pages.

Chen, Q. "Canonical Wnt signaling in diabetic retinopathy" Vision Research (2017); 139:47-58.

Extended European Search Report for European Application No. EP20835032.2 dated Apr. 24, 2024, 14 pages.

Partial Supplementary European Search Report for European Application No. EP20835032.2 dated Feb. 2, 2024, 17 pages.

Povelones et al., "Genetic evidence that *Drosophila* frizzled controls planar cell polarity and Armadillo signaling by a common mechanism," Genetics (Dec. 2005); 171(4):1643-1654.

* cited by examiner

*Primary Examiner* — Misook Yu
*Assistant Examiner* — Alec Jon Peters
(74) *Attorney, Agent, or Firm* — Cooley LLP

(57) ABSTRACT

The present invention provides anti-Fzd monoclonal antibodies and related compositions, which may be used in any of a variety of therapeutic methods for the treatment of diseases.

10 Claims, 7 Drawing Sheets

Specification includes a Sequence Listing.

```
#  Percent Identity Matrix - created by Clustal2.1

1: hFzd7-hinge  100.00   44.12   39.47
   2: hFzd1-hinge   44.12  100.00   44.68
   3: hFzd2-hinge   39.47   44.68  100.00

CLUSTAL O(1.2.4) multiple sequence alignment hFzd7-hinge  CVGQNTSDGSGGA------------------------GGSPTAYPTAPYLPDPPFTAMSPSDGRGRLS  44
hFzd1-hinge  CVGQNTSDKGTPTPSLLPEFWTSNPQHGGGGHRGGFPGGAG-----------ASE------R  45
hFzd2-hinge  CVGQNHSEDGAPALL--TTAPPPGLQPGAGGTPGG--PGGGG-------------APPRYATLE  47
             *****  *:    .     .                  **   .     .      .

hFzd7-hinge  FPFSC  49
hFzd1-hinge  GKFSC  50
hFzd2-hinge  HPFHC  52
             * *
```

FIG. 3

A
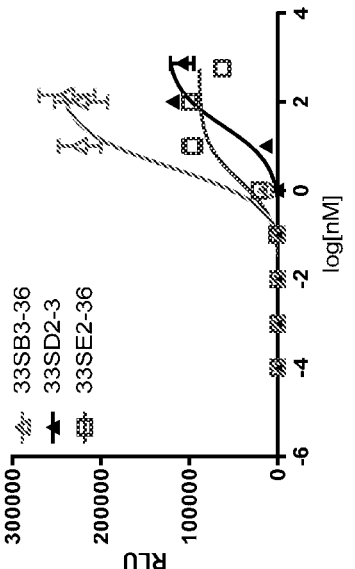
B
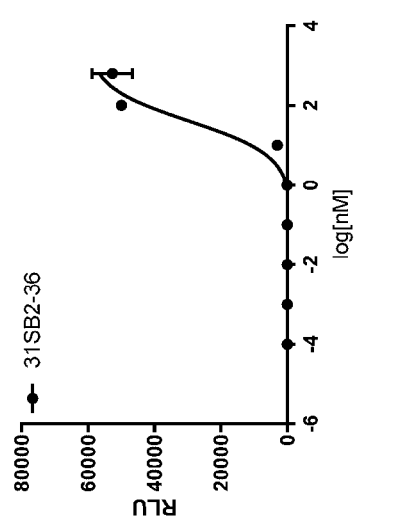
FIG. 5

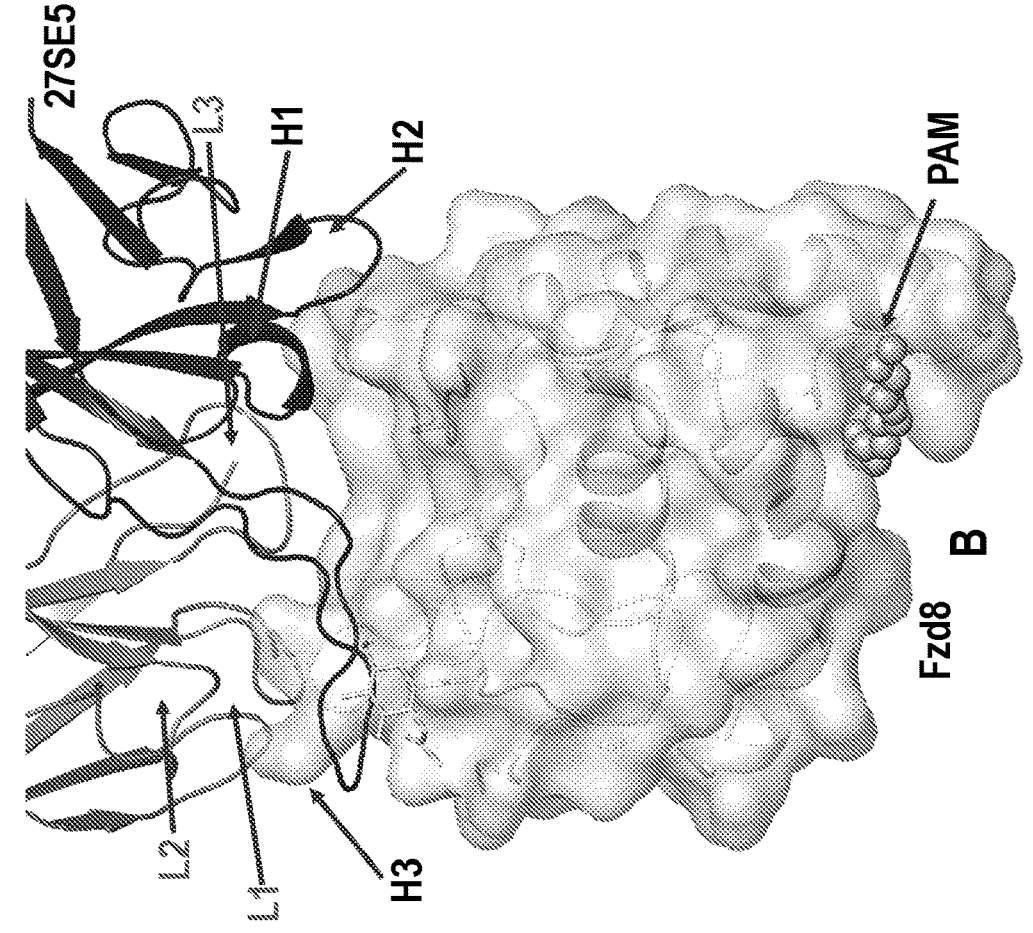
FIG .6

MONOSPECIFIC ANTI-FRIZZLED ANTIBODIES AND METHODS OF USE

CROSS REFERENCE TO RELATED APPLICATIONS

This application is the National Stage of International Application No. PCT/US2020/040736, filed Jul. 2, 2020, which claims priority to U.S. Provisional Application No. 62/869,976, filed Jul. 2, 2019, and U.S. Provisional Application No. 62/875,073, filed Jul. 17, 2019, each of which is incorporated by reference herein in its entirety.

CROSS REFERENCE TO RELATED APPLICATIONS

This application claims priority to U.S. Provisional Application No. 62/869,976, filed Jul. 2, 2019, and U.S. Provisional Application No. 62/875,073, filed Jul. 17, 2019, each of which is incorporated by reference herein in its entirety.

BACKGROUND

Technical Field

The present invention relates generally to monospecific anti-Frizzled antibodies and antigen-binding fragments thereof, compositions, and methods of using the same. Such antibodies are useful, for example, in modulating Wnt signaling pathways.

Description of the Related Art

Wnt ("Wingless-related integration site" or "Wingless and Int-1" or "Wingless-Int") ligands and their signals play key roles in the control of development, homeostasis and regeneration of many essential organs and tissues, including bone, liver, skin, stomach, intestine, kidney, central nervous system, mammary gland, taste bud, ovary, cochlea and many other tissues (reviewed, e.g., by Clevers, Loh, and Nusse, 2014; 346:1248012). Modulation of Wnt signaling pathways has potential for treatment of degenerative diseases and tissue injuries.

One of the challenges for modulating Wnt signaling as a therapeutic is the existence of multiple Wnt ligands and Wnt receptors, Frizzled 1-10 (Fzd1-10), with many tissues expressing multiple and overlapping Fzds. Canonical Wnt signals also involve Low-density lipoprotein (LDL) receptor-related protein 5 (LRP5) or Low-density lipoprotein (LDL) receptor-related protein 6 (LRP6) as co-receptors, which are broadly expressed in various tissues, in addition to Fzds. Accordingly, there is clearly a need in the art for binding moieties, such as antibodies, that specifically bind to one or more Fzd, LRP5, or LRP6. The present invention addresses this need.

BRIEF SUMMARY

In various embodiments, the present invention provides anti-Fzd antibodies and antigen-binding fragments thereof and related methods of use.

In one embodiment, the disclosure provides an isolated antibody, or an antigen-binding fragment thereof, that binds to one or more Frizzled receptor, comprising a sequence comprising: (i) CDRH1, CDRH2 and CDRH3 sequences set forth for any of the antibodies of Table 1; and/or (ii) CDRL1, CDRL2 and CDRL3 sequences set forth for any of the antibodies of Table 1, or a variant of said antibody, or antigen-binding fragment thereof, comprising one or more amino acid modifications, wherein said variant comprises less than 8 amino acid substitutions in said CDR sequences.

In particular embodiments, any of the antibodies, or antigen-binding fragments thereof, are humanized. In certain embodiments, any of the antibodies, or antigen-binding fragments thereof, are a single chain antibody, a scFv, a univalent antibody lacking a hinge region, a VHH or single domain antibody (sdAb), or a minibody. In particular embodiments, any of the antibodies, or antigen-binding fragments thereof, are a Fab or a Fab' fragment.

In certain embodiments, any of the antibodies, or antigen-binding fragments thereof, are a fusion protein. In certain embodiments, the antibody, or antigen-binding fragment thereof, is fused to a polypeptide sequence that binds LRP5 or LRP6. In certain embodiments, the polypeptide sequence that binds LRP5 or LRP6 is an antibody, or an antigen-binding fragment thereof, that binds to LRP5 or LRP6.

In particular embodiments of any of the antibodies, or antigen-binding fragments thereof, the antibody, or antigen-binding fragment thereof, binds to Frizzled 1 (Fzd1), Frizzled 2 (Fzd2), Frizzled 3 (Fzd3), Frizzled 4 (Fzd4), Frizzled 5 (Fzd5), Frizzled 6 (Fzd6), Frizzled 7 (Fzd7), Frizzled 8 (Fzd8), Frizzled 9 (Fzd9), and Frizzled 10 (Fzd10).

In a related embodiment, the disclosure provides an isolated antibody, or an antigen-binding fragment thereof, that competes with any of the antibodies disclosed herein for binding to a human Fzd receptor.

In particular embodiments, any of the antibodies, or antigen-binding fragments thereof, bind to the Fzd with a KD of 50 µM or lower.

In particular embodiments, any of the antibodies, or antigen-binding fragments thereof, modulate a Wnt signaling pathway in a cell, optionally a mammalian cell. In particular embodiments, any of the antibodies, or antigen-binding fragments thereof increase signaling via a Wnt signaling pathway in the cell. In particular embodiments, any of the antibodies, or antigen-binding fragments thereof decrease signaling via a Wnt signaling pathway in the cell. In certain embodiments, the Wnt signaling pathway is a canonical Wnt signaling pathway or a non-canonical Wnt signaling pathway.

In a further related embodiment, the present disclosure provides an isolated polynucleotide encoding an antibody, or antigen-binding fragment thereof, disclosed herein. In certain embodiments, the present disclosure provides an expression vector comprising the isolated polynucleotide and an isolated host cell comprising the expression vector.

In another embodiment, the present disclosure provides a pharmaceutical composition comprising a physiologically acceptable excipient, diluent, or carrier, and a therapeutically effective amount of the isolated antibody, or antigen-binding fragment thereof, disclosed herein.

In a further embodiment, the present disclosure provides a method for agonizing a Wnt signaling pathway in a cell, comprising contacting the cell with an isolated antibody, or antigen-binding fragment thereof, disclosed herein that increases Wnt signaling. In particular embodiments, the antibody, or antigen-binding fragment thereof, is a fusion protein comprising a polypeptide sequence that binds LRP5 or LRP6.

In another embodiment, the present disclosure provides a method for inhibiting a Wnt signaling pathway in a cell, comprising contacting the cell with the isolated antibody, or antigen-binding fragment thereof, disclosed herein the inhibits Wnt signaling.

In another embodiment, the present disclosure includes a method for treating a subject having a disease or disorder associated with reduced Wnt signaling, comprising administering to the subject an effective amount of a pharmaceutical composition comprising an isolated antibody, or antigen-binding fragment thereof, disclosed herein that is an agonist of a Wnt signaling pathway. In particular embodiments, the disease or disorder is selected from the group consisting of: bone fractures, stress fractures, vertebral compression fractures, osteoporosis, osteoporotic fractures, nonunion fractures, delayed union fractures, spinal fusion, preoperative optimization for spine surgeries, osteonecrosis, osseointegration of implants or orthopedic devices, osteogenesis imperfecta, bone grafts, tendon repair, tendon-bone integration, tooth growth and regeneration, maxillofacial surgery, dental implantation, periodontal diseases, maxillofacial reconstruction, osteonecrosis of the jaw, hip or femoral head, avascular necrosis, alopecia, hearing loss, vestibular hypofunction, macular degeneration, age-related macular degeneration (AMD), vitreoretinopathy, retinopathy, diabetic retinopathy, diseases of retinal degeneration, Fuchs' dystrophy, cornea diseases, stroke, traumatic brain injury, Alzheimer's disease, multiple sclerosis, diseases affecting blood brain barrier (BBB), spinal cord injuries, spinal cord diseases, oral mucositis, short bowel syndrome, inflammatory bowel diseases (IBD), Crohn's disease (CD), ulcerative colitis (UC), in particular CD with fistula formation, metabolic syndrome, dyslipidemia, diabetes, pancreatitis, exocrine pancreatic insufficiency, wound healing, diabetic foot ulcers, pressure sores, venous leg ulcers, epidermolysis bullosa, dermal hypoplasia, myocardial infarction, coronary artery disease, heart failure, hematopoietic cell disorders, immunodeficiencies, graft versus host diseases, acute kidney injuries, chronic kidney diseases, chronic obstructive pulmonary diseases (COPD), idiopathic pulmonary fibrosis, acute liver failure of all causes, acute liver failure drug-induced, alcoholic liver diseases, chronic liver failure of all causes, cirrhosis, liver fibrosis of all causes, portal hypertension, chronic liver insufficiency of all causes, end stage liver disease (ESLD), nonalcoholic steatohepatitis (NASH), nonalcoholic fatty liver disease (NAFLD) (fatty liver), alcoholic hepatitis, hepatitis C virus-induced liver diseases (HCV), hepatitis B virus-induced liver diseases (HBV), other viral hepatitis (e.g., hepatitis A virus-induced liver diseases (HAV) and hepatitis D virus-induced liver diseases (HDV)), primary biliary cirrhosis, autoimmune hepatitis, livery surgery, liver injury, liver transplantation, "small for size" syndrome in liver surgery and transplantation, congenital liver disease and disorders, any other liver disorder or detect resulting from genetic diseases, degeneration, aging, drugs, or injuries.

In a related embodiment, the present disclosure provides a method for treating a subject having a disease or disorder associated with increased or enhanced Wnt signaling, comprising administering to the subject an effective amount of the pharmaceutical composition comprising an isolated antibody, or antigen-binding fragment thereof, disclosed herein that is an inhibitor of a Wnt signaling pathway. In certain embodiments, the disease or disorder is selected from the group consisting of: tumors and cancers, degenerative disorders, fibrosis, heart failure, coronary artery disease, heterotopic ossification, osteopetrosis, and congenital high bone mass disorders.

In a further related embodiment, the present disclosure provides an isolated antibody, or an antigen-binding fragment thereof, that binds one or an epitope within a region of Frizzled 8 comprising or consisting of amino acid residues 55-137.

In certain embodiments, the present disclosure provides an isolated antibody, or an antigen-binding fragment thereof, that binds one or more Frizzled receptor, wherein the antibody or antigen-binding fragment thereof contacts the Frizzled receptor with a distance of less than 5 angstroms, or between 5 and 8 angstroms at any of the sets of amino acid residues indicated in Table 4.

BRIEF DESCRIPTION OF THE DRAWINGS

FIG. 3. Percent identity and sequence comparison of Fzd1 (SEQ ID NO: 1), Fzd2 (SEQ ID NO: 2) and Fzd7 (SEQ ID NO: 7) hinge regions.

FIGS. 5A-B. In vitro activity of 33SB3-36, 33SD2-3, 33SE2-36 (FIG. 5A), and 31SB2-36 (FIG. 5B) Wnt surrogate molecules.

FIGS. 6A-6B. Shows the binding residues of crystallized 027S-E05:hFzd8. FIG. 6A depicts the overall structure of Fzd8:27SE5 complex. Molecular-surface of Fzd8 shown in light-gray transparent surface. Heavy- and Light-chains of 27SE5 are colored in shades of darker- and lighter-black, respectively. The lipid (palmitoleic acid; PAM) as observed in the structure of Wnt8:Fzd8 (PDB code: 4FOA) is shown in light-gray spheres. FIG. 6B is a close-up view of the Fzd8:27SE5 interface with positions of CDR loops H1, H2, H3 of heavy-chain and L1, L2, and L3 of light-chain are marked. Glycosylation on Fzd8 is shown in sticks representation.

DETAILED DESCRIPTION

Figure 1:
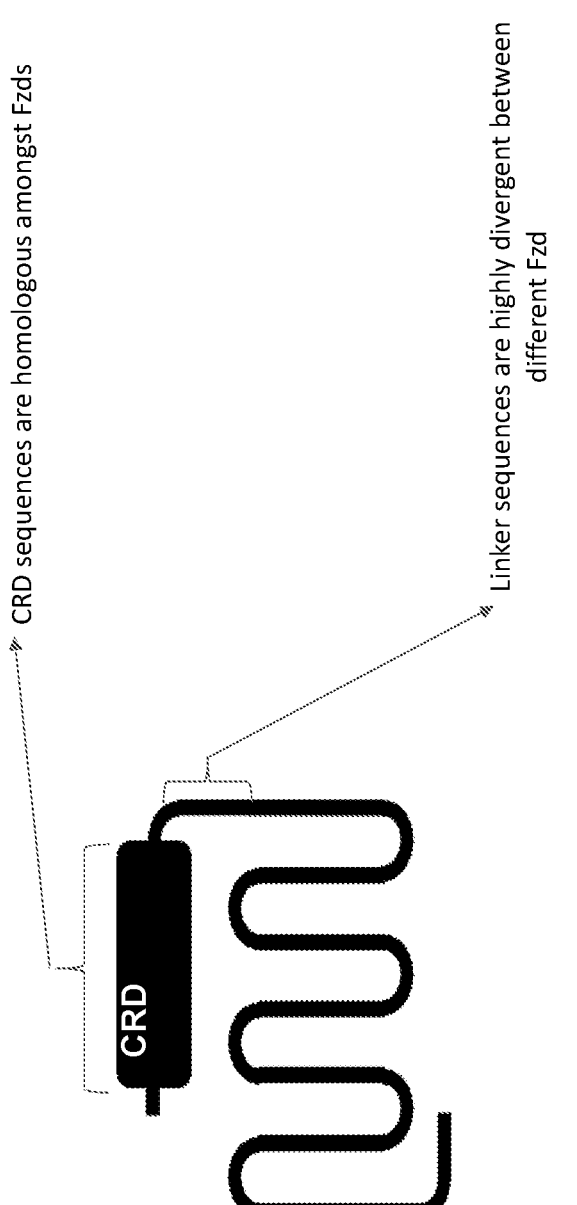
FIG. 1. Schematic diagram of a Fzd receptor including a cysteine rich domain (CRD), hinge region, and N-terminal region.

The present disclosure relates to antibodies and antigen-binding fragments thereof that specifically a Fzd receptor, including antibodies having particular Fzd receptor specificity and/or functional properties. One embodiment of the invention encompasses specific humanized antibodies and fragments thereof capable of binding to a Fzd receptor and modulate downstream Wnt pathway signaling and related biological effects.

Embodiments of the invention pertain to the use of anti-Fzd antibodies or antigen-binding fragments thereof for the diagnosis, assessment and treatment of diseases and disorders associated with Wnt signaling pathways. In certain embodiments, the subject antibodies and antigen-binding fragments thereof are used to modulate a Wnt signaling pathway in a cell or tissue. In certain embodiments, the subject antibodies and antigen-binding fragments thereof are used in the treatment or prevention of diseases and disorders associated with aberrant or deregulated (e.g., either increased or reduced) Wnt signaling, or for which either decreasing or increasing Wnt signaling would provide a therapeutic benefit.

The practice of the present invention will employ, unless indicated specifically to the contrary, conventional methods of virology, immunology, microbiology, molecular biology and recombinant DNA techniques within the skill of the art, many of which are described below for the purpose of illustration. Such techniques are explained fully in the literature. See, e.g., *Current Protocols in Molecular Biology* or *Current Protocols in Immunology*, John Wiley & Sons, New York, N.Y. (2009); Ausubel et al., *Short Protocols in Molecular Biology*, $3^{rd}$ ed., Wiley & Sons, 1995; Sambrook and Russell, *Molecular Cloning: A Laboratory Manual* (3rd Edition, 2001); Maniatis et al. *Molecular Cloning: A Laboratory Manual* (1982); *DNA Cloning: A Practical Approach*, vol. I & II (D. Glover, ed.); *Oligonucleotide Synthesis* (N. Gait, ed., 1984); *Nucleic Acid Hybridization* (B. Hames & S. Higgins, eds., 1985); *Transcription and Translation* (B. Hames & S. Higgins, eds., 1984); *Animal Cell Culture* (R. Freshney, ed., 1986); Perbal, *A Practical Guide to Molecular Cloning* (1984) and other like references.

As used in this specification and the appended claims, the singular forms "a," "an" and "the" include plural references unless the content clearly dictates otherwise.

Throughout this specification, unless the context requires otherwise, the word "comprise", or variations such as "comprises" or "comprising", will be understood to imply the inclusion of a stated element or integer or group of elements or integers but not the exclusion of any other element or integer or group of elements or integers.

Each embodiment in this specification is to be applied mutatis mutandis to every other embodiment unless expressly stated otherwise.

Standard techniques may be used for recombinant DNA, oligonucleotide synthesis, and tissue culture and transformation (e.g., electroporation, lipofection). Enzymatic reactions and purification techniques may be performed according to manufacturer's specifications or as commonly accomplished in the art or as described herein. These and related techniques and procedures may be generally performed according to conventional methods well known in the art and as described in various general and more specific references that are cited and discussed throughout the present specification. Unless specific definitions are provided, the nomenclature utilized in connection with, and the laboratory procedures and techniques of, molecular biology, analytical chemistry, synthetic organic chemistry, and medicinal and pharmaceutical chemistry described herein are those well-known and commonly used in the art. Standard techniques may be used for recombinant technology, molecular biological, microbiological, chemical syntheses, chemical analyses, pharmaceutical preparation, formulation, and delivery, and treatment of subjects.

Embodiments of the present invention relate to antibodies and antigen-binding fragments thereof that bind to one or more Fzd receptor. Sequences of illustrative antibodies, or antigen-binding fragments, or complementarity determining regions (CDRs) thereof, are set forth in Table 1.

As is well known in the art, an antibody is an immunoglobulin molecule capable of specific binding to a target, such as a carbohydrate, polynucleotide, lipid, polypeptide, etc., through at least one epitope recognition site, located in the variable region of the immunoglobulin molecule. As used herein, the term encompasses not only intact polyclonal or monoclonal antibodies, but also fragments thereof (such as dAb, Fab, Fab', $F(ab')_2$, Fv), single chain (scFv), VHH or sdAb (also known as a Nanobody®), synthetic variants thereof, naturally occurring variants, fusion proteins comprising an antibody or an antigen-binding fragment thereof, humanized antibodies, chimeric antibodies, and any other modified configuration of the immunoglobulin molecule that comprises an antigen-binding site or fragment (epitope recognition site) of the required specificity. "Diabodies", multivalent or multispecific fragments constructed by gene fusion (WO94/13804; P. Holliger et al., Proc. Natl. Acad. Sci. USA 90 6444-6448, 1993) are also a particular form of antibody contemplated herein. Minibodies comprising a scFv joined to a CH3 domain are also included herein (S. Hu et al., Cancer Res., 56, 3055-3061, 1996). See e.g., Ward, E. S. et al., Nature 341, 544-546 (1989); Bird et al., Science, 242, 423-426, 1988; Huston et al., PNAS USA, 85, 5879-5883, 1988); PCT/US92/09965; WO94/13804; P. Holliger et al., Proc. Natl. Acad. Sci. USA 90 6444-6448, 1993; Y. Reiter et al., Nature Biotech, 14, 1239-1245, 1996; S. Hu et al., Cancer Res., 56, 3055-3061, 1996.

The term "antigen-binding fragment" as used herein refers to a polypeptide fragment that contains at least one CDR of an immunoglobulin heavy and/or light chain that binds to the antigen of interest, in particular to one or more Fzd receptor. In this regard, an antigen-binding fragment of the herein described antibodies may comprise 1, 2, 3, 4, 5, or all 6 CDRs of a VH and VL sequence set forth herein from antibodies that bind one or more Fzd receptor. An antigen-binding fragment of the Fzd-specific antibodies described herein is capable of binding to a Fzd receptor. As used herein, the term encompasses not only isolated fragments but also polypeptides comprising an antigen-binding fragment of an antibody disclosed herein, such as, for example, fusion proteins comprising an antigen-binding fragment of an antibody disclosed herein.

In certain embodiments, an antibody or antigen-binding fragment thereof, modulates Wnt signaling events in a cell contacted with the antibody or antigen-binding fragment thereof. In certain embodiments, the antibody or antigen-binding fragment thereof increases Wnt signaling, while in other embodiments, it decreases Wnt signaling. In certain embodiments, the antibody or antigen-binding fragment thereof binds specifically to and/or modulates the biological activity of the human Wnt signaling pathway.

The term "antigen" refers to a molecule or a portion of a molecule capable of being bound by a selective binding agent, such as an antibody, and additionally capable of being used in an animal to produce antibodies capable of binding to an epitope of that antigen. In certain embodiments, an antibody is said to specifically bind an antigen when it preferentially recognizes its target antigen in a complex mixture of proteins and/or macromolecules. In certain embodiments, an antibody is said to specifically bind an antigen when the equilibrium dissociation constant is $\leq 10^{-7}$ or $10^{-8}$ M. In some embodiments, the equilibrium dissociation constant may be $\leq 10^{-9}$ M or $\leq 10^{-10}$ M.

In certain embodiments, antibodies and antigen-binding fragments thereof as described herein include a heavy chain and a light chain CDR set, respectively interposed between a heavy chain and a light chain framework region (FR) set which provide support to the CDRs and define the spatial relationship of the CDRs relative to each other. As used herein, the term "CDR set" refers to the three hypervariable regions of a heavy or light chain V region. Proceeding from the N-terminus of a heavy or light chain, these regions are denoted as "CDR1," "CDR2," and "CDR3" respectively. An antigen-binding site, therefore, includes six CDRs, comprising the CDR set from each of a heavy and a light chain V region. A polypeptide comprising a single CDR, (e.g., a CDR1, CDR2 or CDR3) is referred to herein as a "molecular recognition unit." Crystallographic analysis of a number of antigen-antibody complexes has demonstrated that the amino acid residues of CDRs form extensive contact with bound antigen, wherein the most extensive antigen contact is with the heavy chain CDR3. Thus, the molecular recognition units are primarily responsible for the specificity of an antigen-binding site.

As used herein, the term "FR set" refers to the four flanking amino acid sequences which frame the CDRs of a CDR set of a heavy or light chain V region. Some FR residues may contact bound antigen; however, FRs are primarily responsible for folding the V region into the antigen-binding site, particularly the FR residues directly adjacent to the CDRs. Within FRs, certain amino residues and certain structural features are very highly conserved. In this regard, all V region sequences contain an internal disulfide loop of around 90 amino acid residues. When the V regions fold into a binding-site, the CDRs are displayed as projecting loop motifs which form an antigen-binding surface. It is generally recognized that there are conserved structural regions of FRs which influence the folded shape of the CDR loops into certain "canonical" structures—regardless of the precise CDR amino acid sequence. Further, certain FR residues are known to participate in non-covalent interdomain contacts which stabilize the interaction of the antibody heavy and light chains.

The structures and locations of immunoglobulin CDRs and variable domains may be determined by reference to Kabat, E. A. et al., Sequences of Proteins of Immunological Interest. 4th Edition. US Department of Health and Human Services. 1987, and updates thereof, now available on the Internet (immuno.bme.nwu.edu). Alternatively, CDRs may be determined by using "IMGT®, the international ImMunoGeneTics information System® available at http://www.imgt.org (see, e.g., Lefranc, M.-P. et al. (1999) *Nucleic Acids Res.,* 27:209-212; Ruiz, M. et al. (2000) *Nucleic Acids Res.,* 28:219-221; Lefranc, M.-P. (2001) *Nucleic Acids Res.,* 29:207-209; Lefranc, M.-P. (2003) *Nucleic Acids Res.,* 31:307-310; Lefranc, M.-P. et al. (2004) *In Silico* Biol., 5, 0006 [Epub], 5:45-60 (2005)]; Lefranc, M.-P. et al. (2005) *Nucleic Acids Res.,* 33:D593-597; Lefranc, M.-P. et al. (2009) *Nucleic Acids Res.,* 37:D1006-1012; Lefranc, M.-P. et al. (2015) *Nucleic Acids Res.,* 43:D413-422). The CDRs of the antibodies described herein were determined using either the IMGT® system or using the Abgenesis software from Distributed Bio to map the specificity determining regions (SDRs) shown below, which include the Kabat definition of CDRs (Padlan et al. *FASEB J.* 9, 133-139 (1995).

A "monoclonal antibody" refers to a homogeneous antibody population wherein the monoclonal antibody is comprised of amino acids (naturally occurring and non-naturally occurring) that are involved in the selective binding of an epitope. Monoclonal antibodies are highly specific, being directed against a single epitope. The term "monoclonal antibody" encompasses not only intact monoclonal antibodies and full-length monoclonal antibodies, but also fragments thereof (such as Fab, Fab', F(ab')₂, Fv), single chain (scFv), VHH or sdAb, variants thereof, fusion proteins comprising an antigen-binding fragment of a monoclonal antibody, humanized monoclonal antibodies, chimeric monoclonal antibodies, and any other modified configuration of the immunoglobulin molecule that comprises an antigen-binding fragment (epitope recognition site) of the required specificity and the ability to bind to an epitope. It is not intended to be limited as regards the source of the antibody or the manner in which it is made (e.g., by hybridoma, phage selection, recombinant expression, transgenic animals, etc.). The term includes whole immunoglobulins as well as the fragments etc. described above under the definition of "antibody".

The proteolytic enzyme papain preferentially cleaves IgG molecules to yield several fragments, two of which (the F(ab) fragments) each comprise a covalent heterodimer that includes an intact antigen-binding site. The enzyme pepsin is able to cleave IgG molecules to provide several fragments, including the F(ab')₂ fragment which comprises both antigen-binding sites. An Fv fragment for use according to certain embodiments of the present invention can be produced by preferential proteolytic cleavage of an IgM, and on rare occasions of an IgG or IgA immunoglobulin molecule. Fv fragments are, however, more commonly derived using recombinant techniques known in the art. The Fv fragment includes a non-covalent $V_H::V_L$ heterodimer including an antigen-binding site which retains much of the antigen recognition and binding capabilities of the native antibody molecule. Inbar et al. (1972) *Proc. Nat. Acad. Sci. USA* 69:2659-2662; Hochman et al. (1976) *Biochem* 15:2706-2710; and Ehrlich et al. (1980) *Biochem* 19:4091-4096.

In certain embodiments, single chain Fv or scFV antibodies are contemplated. For example, Kappa bodies (Ill et al., *Prot. Eng.* 10: 949-57 (1997); minibodies (Martin et al., *EMBO J* 13: 5305-9 (1994); diabodies (Holliger et al., *PNAS* 90: 6444-8 (1993); or Janusins (Traunecker et al., *EMBO J* 10: 3655-59 (1991) and Traunecker et al., *Int. J. Cancer Suppl.* 7: 51-52 (1992), may be prepared using standard molecular biology techniques following the teachings of the present application with regard to selecting antibodies having the desired specificity. In still other embodiments, bispecific or chimeric antibodies may be made that encompass the ligands of the present disclosure. For example, a chimeric antibody may comprise CDRs and framework regions from different antibodies, while bispecific antibodies may be generated that bind specifically to one or more Fzd receptor through one binding domain and to a second molecule through a second binding domain. These antibodies may be produced through recombinant molecular biological techniques or may be physically conjugated together.

A single chain Fv (scFv) polypeptide is a covalently linked $V_H::V_L$ heterodimer which is expressed from a gene fusion including $V_H$- and $V_L$-encoding genes linked by a peptide-encoding linker. Huston et al. (1988) *Proc. Nat. Acad. Sci. USA* 85(16):5879-5883. A number of methods have been described to discern chemical structures for converting the naturally aggregated-but chemically separated-light and heavy polypeptide chains from an antibody V region into an scFv molecule which will fold into a three dimensional structure substantially similar to the structure of an antigen-binding site. See, e.g., U.S. Pat. Nos. 5,091,513 and 5,132,405, to Huston et al.; and U.S. Pat. No. 4,946,778, to Ladner et al.

In certain embodiments, a Fzd binding antibody as described herein is in the form of a diabody. Diabodies are multimers of polypeptides, each polypeptide comprising a first domain comprising a binding region of an immunoglobulin light chain and a second domain comprising a binding region of an immunoglobulin heavy chain, the two domains being linked (e.g. by a peptide linker) but unable to associate with each other to form an antigen binding site: antigen binding sites are formed by the association of the first domain of one polypeptide within the multimer with the second domain of another polypeptide within the multimer (WO94/13804).

A dAb fragment of an antibody consists of a VH domain (Ward, E. S. et al., Nature 341, 544-546 (1989)).

Where bispecific antibodies are to be used, these may be conventional bispecific antibodies, which can be manufactured in a variety of ways (Holliger, P. and Winter G. *Current Opinion Biotechnol.* 4, 446-449 (1993)), e.g. prepared chemically or from hybrid hybridomas, or may be any of the bispecific antibody fragments mentioned above. Diabodies and scFv can be constructed without an Fc region, using only variable domains, potentially reducing the effects of anti-idiotypic reaction.

Bispecific diabodies, as opposed to bispecific whole antibodies, may also be particularly useful because they can be readily constructed and expressed in *E. coli*. Diabodies (and many other polypeptides such as antibody fragments) of appropriate binding specificities can be readily selected using phage display (WO94/13804) from libraries. If one arm of the diabody is to be kept constant, for instance, with a specificity directed against antigen X, then a library can be made where the other arm is varied and an antibody of appropriate specificity selected. Bispecific whole antibodies may be made by knobs-into-holes engineering (J. B. B. Ridgeway et al., *Protein Eng.,* 9, 616-621, 1996).

In certain embodiments, the antibodies described herein may be provided in the form of a UniBody®. A UniBody® is an IgG4 antibody with the hinge region removed (see GenMab Utrecht, The Netherlands; see also, e.g., US20090226421). This proprietary antibody technology creates a stable, smaller antibody format with an anticipated longer therapeutic window than current small antibody formats. IgG4 antibodies are considered inert and thus do not interact with the immune system. Fully human IgG4 antibodies may be modified by eliminating the hinge region of the antibody to obtain half-molecule fragments having distinct stability properties relative to the corresponding intact IgG4 (GenMab, Utrecht). Halving the IgG4 molecule leaves only one area on the UniBody® that can bind to cognate antigens (e.g., disease targets) and the UniBody® therefore binds univalently to only one site on target cells.

In certain embodiments, the antibodies of the present disclosure may take the form of a VHH or sdAb. VHH or sdAb technology was originally developed following the discovery and identification that camelidae (e.g., camels and llamas) possess fully functional antibodies that consist of heavy chains only and therefore lack light chains. These heavy-chain only antibodies contain a single variable domain ($V_{HH}$) and two constant domains ($C_H^2$, $C_H^3$). The cloned and isolated single variable domains have full antigen binding capacity and are very stable. These single variable domains, with their unique structural and functional properties, form the basis of "VHH or sdAb". VHH or sdAb are encoded by single genes and are efficiently produced in almost all prokaryotic and eukaryotic hosts e.g. *E. coli* (see e.g. U.S. Pat. No. 6,765,087), molds (for example *Aspergillus* or *Trichoderma*) and yeast (for example *Saccharomyces, Kluyvermyces, Hansenula* or *Pichia* (see e.g. U.S. Pat. No. 6,838,254). The production process is scalable and multi-kilogram quantities of VHH or sdAb have been produced. VHH or sdAb may be formulated as a ready-to-use solution having a long shelf life. The Nanoclone® method (see, e.g., WO 06/079372) is a proprietary method for generating VHH or sdAb against a desired target, based on automated high-throughput selection of B-cells. VHH or sdAb are single-domain antigen-binding fragments of camelid-specific heavy-chain only antibodies. VHH or sdAb, typically have a small size of around 15 kDa.

In certain embodiments, the anti-Fzd antibodies or antigen-binding fragments thereof as disclosed herein are humanized. This refers to a chimeric molecule, generally prepared using recombinant techniques, having an antigen-binding site derived from an immunoglobulin from a non-human species and the remaining immunoglobulin structure of the molecule based upon the structure and/or sequence of a human immunoglobulin. The antigen-binding site may comprise either complete variable domains fused onto constant domains or only the CDRs grafted onto appropriate framework regions in the variable domains. Epitope binding sites may be wild type or modified by one or more amino acid substitutions. This eliminates the constant region as an immunogen in human individuals, but the possibility of an immune response to the foreign variable region remains (LoBuglio, A. F. et al., (1989) *Proc Natl Acad Sci USA* 86:4220-4224; Queen et al., *PNAS* (1988) 86:10029-10033; Riechmann et al., *Nature* (1988) 332:323-327). Illustrative methods for humanization of the anti-Fzd antibodies disclosed herein include the methods described in U.S. Pat. No. 7,462,697.

Another approach focuses not only on providing human-derived constant regions, but modifying the variable regions as well so as to reshape them as closely as possible to human form. It is known that the variable regions of both heavy and light chains contain three complementarity-determining regions (CDRs) which vary in response to the epitopes in question and determine binding capability, flanked by four framework regions (FRs) which are relatively conserved in a given species and which putatively provide a scaffolding for the CDRs. When nonhuman antibodies are prepared with respect to a particular epitope, the variable regions can be "reshaped" or "humanized" by grafting CDRs derived from nonhuman antibody on the FRs present in the human antibody to be modified. Application of this approach to various antibodies has been reported by Sato, K., et al., (1993) *Cancer Res* 53:851-856. Riechmann, L., et al., (1988) *Nature* 332:323-327; Verhoeyen, M., et al., (1988) *Science* 239:1534-1536; Kettleborough, C. A., et al., (1991) *Protein Engineering* 4:773-3783; Maeda, H., et al., (1991) *Human Antibodies Hybridoma* 2:124-134; Gorman, S. D., et al., (1991) *Proc Nat Acad Sci USA* 88:4181-4185; Tempest, P. R., et al., (1991) *Bia/Technology* 9:266-271; Co, M. S., et al., (1991) *Proc Natl Acad Sci USA* 88:2869-2873; Carter, P., et al., (1992) *Proc Natl Acad Sci USA* 89:4285-4289; and Co, M. S. et al., (1992) *J Immunol* 148:1149-1154. In some embodiments, humanized antibodies preserve all CDR sequences (for example, a humanized mouse antibody which contains all six CDRs from the mouse antibodies). In other embodiments, humanized antibodies have one or more CDRs (one, two, three, four, five, six) which are altered with respect to the original antibody, which are also termed one or more CDRs "derived from" one or more CDRs from the original antibody.

In certain embodiments, the antibodies of the present disclosure may be chimeric antibodies. In this regard, a chimeric antibody is comprised of an antigen-binding fragment of an anti-Fzd antibody operably linked or otherwise fused to a heterologous Fc portion of a different antibody. In certain embodiments, the heterologous Fc domain is of human origin. In other embodiments, the heterologous Fc domain may be from a different Ig class from the parent antibody, including IgA (including subclasses IgA1 and IgA2), IgD, IgE, IgG (including subclasses IgG1, IgG2, IgG3, and IgG4), and IgM. In further embodiments, the heterologous Fc domain may be comprised of CH2 and CH3 domains from one or more of the different Ig classes. As noted above with regard to humanized antibodies, the anti-Fzd antigen-binding fragment of a chimeric antibody may comprise only one or more of the CDRs of the antibodies described herein (e.g., 1, 2, 3, 4, 5, or 6 CDRs of the antibodies described herein), or may comprise an entire variable domain (VL, VH or both).

In certain embodiments, antibodies or antigen-binding fragments thereof disclosed herein include fusion proteins, e.g., Wnt signaling pathway agonist fusion proteins, also referred to herein as "Wnt surrogates." Wnt surrogates of the present invention are usually biologically active in binding to a cognate Frizzled receptor, and in activation of Wnt signaling, i.e., the surrogate is a Wnt agonist. The term "Wnt agonist activity" refers to the ability of an agonist to mimic the effect or activity of a Wnt protein binding to a frizzled protein. The ability of the agonists of the invention to mimic the activity of Wnt can be confirmed by a number of assays. The agonists of the invention typically initiate a reaction or activity that is similar to or the same as that initiated by the receptor's natural ligand. In particular, the agonists of the invention enhance the canonical Wnt/$\beta$-catenin signaling pathway. As used herein, the term "enhances" refers to a measurable increase in the level of Wnt/$\beta$-catenin signaling compared with the level in the absence of an agonist of the invention.

In particular embodiments, a Wnt signaling pathway agonist fusion protein (or Wnt surrogate) comprises an anti-Fzd antibody, or antigen-binding fragment thereof, disclosed herein fused to a polypeptide that specifically binds to LRP5 and/or LRP6. In particular embodiments, the polypeptide that specifically binds to LRP5 and/or LRP6 is an antibody or antigen-binding fragment thereof. If certain embodiments, it is an antibody or antigen-binding fragment thereof disclosed in application number PCT/US18/66620, titled, "Anti-LRP5/6 antibodies and Methods of Use," filed on Dec. 19, 2018, which is incorporated herein by reference in its entirety.

Suitable LRP5/6 binding domains include, without limitation, de novo designed LRP5/6 binding proteins, antibody derived binding proteins, e.g. scFv, Fab, etc. and other portions of antibodies that specifically bind to one or more Fzd proteins; VHH or sdAb derived binding domains; knottin-based engineered scaffolds; naturally occurring LRP5/6, including without limitation, DKK1, DKK2, DKK3, DKK4, sclerostin; Wise; fusion proteins comprising any of the above; derivatives of any of the above; variants of any of the above; and biologically active fragments of any of the above, and the like. A LRP5/6 binding domain may be affinity selected to enhance binding.

Members of the Dickkopf (DKK) gene family (see Krupnik et al. (1999) Gene 238(2):301-13) include DKK-1, DKK-2, DKK-3, and DKK-4, and the DKK-3 related protein Soggy (Sgy). hDKKs 1-4 contain two distinct cysteine-rich domains in which the positions of 10 cysteine residues are highly conserved between family members. Exemplary sequences of human DKK genes and proteins are publicly available, e.g. Genbank accession number NM_014419 (soggy-1); NM_014420 (DKK4); AF177394 (DKK-1); AF177395 (DKK-2); NM_015881 (DKK3); and NM_014421 (DKK2). In some embodiments of the invention, the Lrp6 binding moiety is a DKK1 peptide, including without limitation the C-terminal domain of human DKK1. The C-terminal domain may comprise the sequence: KMYHTKGQEGSVCLRSSDCASGLCCARHFWSKICK-PVLKEGQVCTKHRRKGSHG LEIFQR- CYCGEGLSCRIQKDHHQASNSSRLHTCQRH (see Genbank accession number NP_036374) (SEQ ID NO:32) or a biologically active fragment thereof.

Binding of DKK proteins to LRP5/6 are discussed, for example in Brott and Sokol Mol. Cell. Biol. 22 (17), 6100-6110 (2002); and Li et al. J. Biol. Chem. 277 (8), 5977-5981 (2002), each herein specifically incorporated by reference. The corresponding region of human DKK2 (Genbank reference NP_055236) may comprise the sequence: KMSHIKGHEGDPCLRSSDCIEGFCCARHFWTKICK-PVLHQGEVCTKQRKKGSHGL EIFQRCD-CAKGLSCKVWKDATYSSKARLHVCQK (SEQ ID NO:33) or a biologically active fragment thereof.

Antibodies that specifically bind to LRP5 or LRP6 are known in the art and are commercially available, or can be generated de novo. LRP5, LRP6 or fragments thereof can be used as an immunogen or in screening assays to develop an antibody. Examples of known antibodies include, without limitation, those described in Gong et al. (2010) PLoS One. 5(9):e12682; Ettenberg et al. (2010) Proc Natl Acad Sci USA. 107(35):15473-8; and those commercially available from, for example Santa Cruz biotechnology antibody clone 1A12, which was raised against synthetic LRP5/6 of human origin and binds to both the full length and proteolytic fragment of LRP 6 and LRP 5 of mouse and human origin; the monoclonal antibody 2B11; Cell Signaling Technology antibody specific for LRP5 (D80F2), catalog number 5731; etc.

In some embodiments, the LRP5/6 binding domain or element may be selected from any domain that binds LRP5/6 at high affinity, e.g. a $K_D$ of at least about $1\times10^{-7}$ M, at least about $1\times10^{-8}$ M, at least about $1\times10^{-9}$ M, at least about $1\times10^{-10}$ M. Suitable LRP5/6 binding domains include, without limitation, de novo designed LRP5/6 binding proteins, antibody derived binding proteins, e.g. scFv, Fab, etc. and other portions of antibodies that specifically bind to one Fzd protein; VHH or sdAb derived binding domains; knottin-based engineered scaffolds; naturally occurring LRP5/6 binding proteins or polypeptides, including without limitation, Norrin, DKK1, DKK2, DKK3, DKK4, sclerostin; and the like. In certain embodiments the LRP5/6 binding domain is a c-terminal portion of DKK1. A LRP5/6 binding domain may be affinity selected to enhance binding.

The anti-Fzd antibody, or antigen binding fragment thereof, and the LRP5/6 binding domain may be directly joined, or may be separated by a linker, e g, a polypeptide linker, or a non-peptidic linker, etc. The region of the Wnt surrogate that binds one Fzd receptor and the polypeptide that binds LRP5 and/or LRP6 may be contiguous or separated by a linker, e.g. a polypeptide linker, or a non-peptidic linker, etc. The length of the linker, and therefore the spacing between the binding domains can be used to modulate the signal strength, and can be selected depending on the desired use of the Wnt surrogate. The enforced distance between binding domains can vary, but in certain embodiments may be less than about 100 angstroms, less than about 90 angstroms, less than about 80 angstroms, less than about 70 angstroms, less than about 60 angstroms, or less than about 50 angstroms. In some embodiments the linker is a rigid linker, in other embodiments the linker is a flexible linker. Where the linker is a peptide linker, it may be from about 1, 2, 3, 4, 5, 6, 7, 8, 9, 10, 11, 12, 13, 14, 15, 16, 17, 18, 19, 20 21, 22, 23, 24, 25, 26, 27, 28, 29, 30 or more amino acids in length, and is of sufficient length and amino acid composition to enforce the distance between binding domains. In some embodiments, the linker comprises or consists of one or more glycine and/or serine residues.

A Wnt surrogate can be multimerized, e.g. through an Fc domain, by concatenation, coiled coils, polypeptide zippers, biotin/avidin or streptavidin multimerization, and the like. The Wnt surrogate can also be joined to a moiety such as PEG, Fc, etc. as known in the art to enhance stability in vivo.

In certain embodiments, a Wnt surrogate direct activates canonical Wnt signaling through binding to one Fzd proteins and to LRP5/6, particularly by binding to these proteins on a cell surface, e.g. the surface of a human cell. The direct activation of Wnt signaling by a Wnt surrogate is in contrast to potentiation of Wnt signaling, which enhances activity only when native Wnt proteins are present.

Wnt surrogates of the present activate Wnt signaling, e.g., by mimicking the effect or activity of a Wnt protein binding to a frizzled protein. The ability of the Wnt surrogates of the invention to mimic the activity of Wnt can be confirmed by a number of assays. The Wnt surrogates typically initiate a reaction or activity that is similar to or the same as that initiated by the receptor's natural ligand. In particular, the Wnt surrogates of the invention enhance the canonical Wnt/β-catenin signaling pathway. As used herein, the term "enhances" refers to a measurable increase in the level of Wnt/β-catenin signaling compared with the level in the absence of a Wnt surrogate of the invention.

In certain embodiments, an antibody or antigen-binding fragment thereof disclosed herein inhibits Wnt pathway signaling. In particular embodiments, binding of an anti-Fzd antibody or antigen-binding fragment thereof blocks or inhibits the binding of endogenous Wnt to one Fzd receptor on a cell surface, thus reducing or inhibiting Wnt signaling.

Various methods are known in the art for measuring the level of canonical Wnt/β-catenin signaling. These include, but are not limited to assays that measure: Wnt/β-catenin target gene expression; TCF reporter gene expression; β-catenin stabilization; LRP phosphorylation: Axin translocation from cytoplasm to cell membrane and binding to LRP. The canonical Wnt/β-catenin signaling pathway ultimately leads to changes in gene expression through the transcription factors TCF7, TCF7L1, TCF7L2 (a.k.a. TCF4), and LEF. The transcriptional response to Wnt activation has been characterized in a number of cells and tissues. As such, global transcriptional profiling by methods well known in the art can be used to assess Wnt/β-catenin signaling activation or inhibition.

Changes in Wnt-responsive gene expression are generally mediated by TCF and LEF transcription factors. A TCF reporter assay assesses changes in the transcription of TCF/LEF controlled genes to determine the level of Wnt/β-catenin signaling. A TCF reporter assay was first described by Korinek, V. et al., 1997. Also known as TOP/FOP this method involves the use of three copies of the optimal TCF motif CCTTTGATC, or three copies of the mutant motif CCTTTGGCC, upstream of a minimal c-Fos promoter driving luciferase expression (pTOPFI_ASH and pFOPFI_ASH, respectively) to determine the transactivational activity of endogenous p-catenin/TCF4. A higher ratio of these two reporter activities (TOP/FOP) indicates higher β-catenin/TCF4 activity, whereas a lower ratio of these two reporter activities indicates lower β-catenin/TCF4 activity.

Various other reporter transgenes that respond to Wit signals exist intact in animals and therefore, effectively reflect endogenous Wnt signaling. These reporters are based on a multimerized TCF binding site, which drives expression of LacZ or GFP, which are readily detectable by methods known in the art. These reporter genes include: TOP-GAL, BAT-GAL, ins-TOPEGFP, ins-TOPGAL, LEF-EGFP, Axin2-LacZ, Axin2-d2EGFP, Lgr5tm1 (cre/ERT2), TOPdGFP.

The recruitment of dephosphorylated β-catenin to the membrane, stabilization and phosphorylation status of β-catenin, and translocation of β-catenin to the nucleus (Klapholz-Brown Z et al., PLoS One. 2(9) e945, 2007), in some cases mediated by complex formation with TCF transcription factors and TNIK are key steps in the Wnt signaling pathway. Stabilization is mediated by Disheveled family proteins that inhibit the "destruction" complex so that degradation of intracellular β-catenin is reduced, and translocation of β-catenin to the nucleus follows thereafter. Therefore, measuring the level and location of β-catenin in a cell is a good reflection of the level of Wnt/β-catenin signaling. A non-limiting example of such an assay is the "BioImage β-Catenin Redistribution Assay" (Thermo Scientific) which provides recombinant U2OS cells that stably express human β-catenin fused to the C-terminus of enhanced green fluorescent protein (EGFP). Imaging and analysis is performed with a fluorescence microscope or HCS platform allowing the levels and distribution of EGFP-β-catenin to be visualized.

Another way, in which the destruction complex is inhibited, is by removal of Axin by recruitment of Axin to the cytoplasmic tail of the Wnt co-receptor LRP. Axin has been shown to bind preferentially to a phosphorylated form of the LRP tail. Visualization of Axin translocation, for example with a GFP-Axin fusion protein, is therefore another method for assessing levels of Wnt/β-catenin signaling.

In certain embodiments, a Wnt signaling pathway agonist enhances or increases canonical Wnt pathway signaling, e.g., β-catenin signaling, by at least 30%, 35%, 40%, 45%, 50%, 60%, 70%, 75%, 80%, 85%, 90%, 95%, 100%, 110%, 150%, 200%, 250%, 300%, 400% or 500%, as compared to the β-catenin signaling induced by a neutral substance or negative control as measured in an assay described above, for example as measured in the TOPFlash assay. A negative control may be included in these assays. In particular embodiments, Wnt agonists may enhance β-catenin signaling by a factor of 2×, 5×, 10×, 100×, 1000×, 10000× or more as compared to the activity in the absence of the agonist when measured in an assay described above, for example when measured in the TOPFlash assay, or any of the other assays mentioned herein.

In certain embodiments, a Wnt signaling pathway antagonist or inhibitor inhibits or decreases canonical Wnt pathway signaling, e.g., β-catenin signaling, by at least 10%, 20%, 30%, 40%, 50%, 60%, 70%, 75%, 80%, 90%, 95%, or 100%, as compared to the β-catenin signaling observed in the presence of a neutral substance or negative control as measured in an assay described above, for example as measured in the TOPFlash assay. A positive control may be included in these assays.

"Wnt gene product" or "Wnt polypeptide" when used herein encompass native sequence Wnt polypeptides, Wnt polypeptide variants, Wnt polypeptide fragments and chimeric Wnt polypeptides. In particular embodiments, a Wnt polypeptide is a native human full length mature Wnt protein.

For example, human native sequence Wnt proteins of interest in the present application include the following: Wnt-1 (GenBank Accession No. NM_005430); Wnt-2 (GenBank Accession No. NM_003391); Wnt-2B (Wnt-13) (GenBank Accession No. NM_004185 (isoform 1), NM_024494.2 (isoform 2)), Wnt-3 (RefSeq.: NM_030753), Wnt3a (GenBank Accession No. NM_033131), Wnt-4

(GenBank Accession No. NM_030761), Wnt-5A (GenBank Accession No. NM_003392), Wnt-5B (GenBank Accession No. NM_032642), Wnt-6 (GenBank Accession No. NM_006522), Wnt-7A (GenBank Accession No. NM_004625), Wnt-7B (GenBank Accession No. NM_058238), Wnt-8A (GenBank Accession No. NM_058244), Wnt-8B (GenBank Accession No. NM_003393), Wnt-9A (Wnt-14) (GenBank Accession No. NM_003395), Wnt-9B (Wnt-15) (GenBank Accession No. NM_003396), Wnt-1 OA (GenBank Accession No. NM_025216), Wnt-10B (GenBank Accession No. NM_003394), Wnt-11 (GenBank Accession No. NM_004626), Wnt-16 (GenBank Accession No. NM_016087)). Although each member has varying degrees of sequence identity with the family, all encode small (i.e., 39-46 kD), acylated, palmitoylated, secreted glycoproteins that contain 23-24 conserved cysteine residues whose spacing is highly conserved (McMahon, A P et al., Trends Genet. 1992; 8: 236-242; Miller, J R. Genome Biol. 2002; 3(1): 3001.1-3001.15). Other native sequence Wnt polypeptides of interest include orthologs of the above from any mammal, including domestic and farm animals, and zoo, laboratory or pet animals, such as dogs, cats, cattle, horses, sheep, pigs, goats, rabbits, rats, mice, frogs, zebra fish, fruit fly, worm, etc.

"Wnt pathway signaling" or "Wnt signaling" is used herein to refer to the mechanism by which a biologically active Wnt exerts its effects upon a cell to modulate a cell's activity. Wnt proteins modulate cell activity by binding to Wnt receptors, including proteins from the Frizzled (Fzd) family of proteins, proteins from the ROR family of proteins, the proteins LRP5, LRP6 from the LRP family of proteins, the protein FRL1/crypto, and the protein Derailed/Ryk. Once activated by Wnt binding, the Wnt receptor(s) will activate one or more intracellular signaling cascades. These include the canonical Wnt signaling pathway; the Wnt/planar cell polarity (Wnt/PCP) pathway; the Wnt-calcium (Wnt/Ca$^{2+}$) pathway (Giles, R H et al. (2003) Biochim Biophys Acta 1653, 1-24; Peifer, M. et al. (1994) Development 120: 369-380; Papkoff, J. et al (1996) Mol. Cell Biol. 16: 2128-2134; Veeman, M. T. et al. (2003) Dev. Cell 5: 367-377); and other Wnt signaling pathways as is well known in the art.

For example, activation of the canonical Wnt signaling pathway results in the inhibition of phosphorylation of the intracellular protein β-catenin, leading to an accumulation of β-catenin in the cytosol and its subsequent translocation to the nucleus where it interacts with transcription factors, e.g. TCF/LEF, to activate target genes. Activation of the Wnt/PCP pathway activates RhoA, c-Jun N-terminal kinase (JNK), and nemo-like kinase (NLK) signaling cascades to control such biological processes as tissue polarity and cell movement. Activation of the Wnt/Ca$^{2+}$ by, for example, binding of Wnt-4, Wnt-5A or Wnt-11, elicits an intracellular release of calcium ions, which activates calcium sensitive enzymes like protein kinase C (PKC), calcium-calmodulin dependent kinase II (CamKII) or calcineurin (CaCN). By assaying for activity of the above signaling pathways, the biological activity of an antibody or antigen-binding fragment thereof, e.g., a Wnt surrogate, can be readily determined.

In certain embodiments, functional properties of anti-Fzd antibodies and antigen-binding fragments thereof may be assessed using a variety of methods known to the skilled person, including e.g., affinity/binding assays (for example, surface plasmon resonance, competitive inhibition assays), cytotoxicity assays, cell viability assays, cell proliferation or differentiation assays in response to a Whit, cancer cell and/or tumor growth inhibition using in vitro or in vivo models, including but not limited to any described herein. Other assays may test the ability of antibodies described herein to block normal Wnt/Fzd-mediated responses. The antibodies and antigen-binding fragments thereof described herein may also be tested for effects on Fzd receptor internalization, in vitro and in vivo efficacy, etc. Such assays may be performed using well-established protocols known to the skilled person (see e.g., Current Protocols in Molecular Biology (Greene Publ. Assoc. Inc. & John Wiley & Sons, Inc., NY, NY); Current Protocols in Immunology (Edited by: John E. Coligan, Ada M. Kruisbeek, David H. Margulies, Ethan M. Shevach, Warren Strober 2001 John Wiley & Sons, NY, NY); or commercially available kits.

In certain embodiments, a Fzd-binding antibody or antigen-binding fragment thereof, e.g., a Whit surrogate, comprises one or more of the CDRs of the antibodies described herein. In this regard, it has been shown in some cases that the transfer of only the VHCDR3 of an antibody can be performed while still retaining desired specific binding (Barbas et al., PNAS (1995) 92: 2529-2533). See also, McLane et al., PNAS (1995) 92:5214-5218, Barbas et al., J. Am. Chem. Soc. (1994) 116:2161-2162.

Marks et al (Bia/Technology, 1992, 10:779-783) describe methods of producing repertoires of antibody variable domains in which consensus primers directed at or adjacent to the 5' end of the variable domain area are used in conjunction with consensus primers to the third framework region of human VH genes to provide a repertoire of VH variable domains lacking a CDR3. Marks et al further describe how this repertoire may be combined with a CDR3 of a particular antibody. Using analogous techniques, the CDR3-derived sequences of the presently described antibodies may be shuffled with repertoires of VH or VL domains lacking a CDR3, and the shuffled complete VH or VL domains combined with a cognate VL or VH domain to provide an antibody or antigen-binding fragment thereof that binds one Fzd receptor. The repertoire may then be displayed in a suitable host system such as the phage display system of WO92/01047 so that suitable antibodies or antigen-binding fragments thereof may be selected. A repertoire may consist of at least from about $10^4$ individual members and upwards by several orders of magnitude, for example, to about from $10^6$ to $10^8$ or $10^{10}$ or more members. Analogous shuffling or combinatorial techniques are also disclosed by Stemmer (Nature, 1994, 370:389-391), who describes the technique in relation to a β-lactamase gene but observes that the approach may be used for the generation of antibodies.

A further alternative is to generate novel VH or VL regions carrying one or more CDR-derived sequences of the herein described invention embodiments using random mutagenesis of one or more selected VH and/or VL genes to generate mutations within the entire variable domain. Such a technique is described by Gram et al (1992, Proc. Natl. Acad. Sci., USA, 89:3576-3580), who used error-prone PCR. Another method which may be used is to direct mutagenesis to CDR regions of VH or VL genes. Such techniques are disclosed by Barbas et al., (1994, Proc. Natl. Acad. Sci., USA, 91:3809-3813) and Schier et al (1996, J. Mol. Biol. 263:551-567).

In certain embodiments, a specific VH and/or VL of the antibodies described herein may be used to screen a library of the complementary variable domain to identify antibodies with desirable properties, such as increased affinity for one Fzd receptor. Such methods are described, for example, in Portolano et al., J. Immunol. (1993) 150:880-887; Clarkson et al., Nature (1991) 352:624-628.

Other methods may also be used to mix and match CDRs to identify antibodies having desired binding activity, such as binding to one Fzd receptor. For example: Klimka et al., *British Journal of Cancer* (2000) 83: 252-260, describe a screening process using a mouse VL and a human VH library with CDR3 and FR4 retained from the mouse VH. After obtaining antibodies, the VH was screened against a human VL library to obtain antibodies that bound antigen. Beiboer et al., J. Mol. Biol. (2000) 296:833-849 describe a screening process using an entire mouse heavy chain and a human light chain library. After obtaining antibodies, one VL was combined with a human VH library with the CDR3 of the mouse retained. Antibodies capable of binding antigen were obtained. Rader et al., PNAS (1998) 95:8910-8915 describe a process similar to Beiboer et al above.

These just-described techniques are, in and of themselves, known as such in the art. The skilled person will, however, be able to use such techniques to obtain antibodies or antigen-binding fragments thereof according to several embodiments of the invention described herein, using routine methodology in the art.

Also disclosed herein is a method for obtaining an antibody or antigen binding domain specific for a Fzd receptor, the method comprising providing by way of addition, deletion, substitution or insertion of one or more amino acids in the amino acid sequence of a VH domain set out herein or a VH domain which is an amino acid sequence variant of the VH domain, optionally combining the VH domain thus provided with one or more VL domains, and testing the VH domain or VH/VL combination or combinations to identify a specific binding member or an antibody antigen binding domain specific for one Fzd receptor and optionally with one or more desired properties. The VL domains may have an amino acid sequence which is substantially as set out herein. An analogous method may be employed in which one or more sequence variants of a VL domain disclosed herein are combined with one or more VH domains.

In particular embodiments, anti-Fzd antibodies, and antigen-binding fragments thereof, are water soluble. By "water soluble" it is meant a composition that is soluble in aqueous buffers in the absence of detergent, usually soluble at a concentration that provides a biologically effective dose of the polypeptide. Compositions that are water soluble form a substantially homogenous composition that has a specific activity that is at least about 5% that of the starting material from which it was purified, usually at least about 10%, 20%, or 30% that of the starting material, more usually about 40%, 50%, or 60% that of the starting material, and may be about 50%, about 90% or greater. Anti-Fzd antibodies and antigen-binding fragments thereof, including Wnt surrogates, of the present invention typically form a substantially homogeneous aqueous solution at concentrations of at least 25 µM and higher, e.g. at least 25 µM, 40 µM, or 50 µM, usually at least 60 µM, 70 µM, 80 µM, or 90 µM, sometimes as much as 100 µM, 120 µM, or 150 µM. In other words, compositions of the present invention typically form a substantially homogeneous aqueous solution at concentrations of about 0.1 mg/ml, about 0.5 mg/ml, of about 1 mg/ml or more.

An antigen or epitope that "specifically binds" or "preferentially binds" (used interchangeably herein) to an antibody or antigen-binding fragment thereof is a term well understood in the art, and methods to determine such specific or preferential binding are also well known in the art. A molecule is said to exhibit "specific binding" or "preferential binding" if it reacts or associates more frequently, more rapidly, with greater duration and/or with greater affinity with a particular cell or substance than it does with alternative cells or substances. An antibody "specifically binds" or "preferentially binds" to a target antigen, e.g., a Fzd receptor, if it binds with greater affinity, avidity, more readily, and/or with greater duration than it binds to other substances. For example, an antibody that specifically or preferentially binds to the Fzd1 receptor is an antibody that binds to the Fzd1 receptor with greater affinity, avidity, more readily, and/or with greater duration than it binds to other Fzd receptors or non-Fzd proteins. It is also understood by reading this definition that, for example, an antibody (or moiety or epitope) that specifically or preferentially binds to a first target may or may not specifically or preferentially bind to a second target. As such, "specific binding" or "preferential binding" does not necessarily require (although it can include) exclusive binding. Generally, but not necessarily, reference to binding means preferential binding.

In some embodiments the frizzled binding moiety is selective for one frizzled protein of interest, e.g. having a specificity for the one desired frizzled protein of at least 10-fold, 25-fold, 50-fold, 100-fold, 200-fold or more relative to other frizzled proteins. In some embodiments, any of the one or more Fzd binding regions of a Wnt surrogate molecule is monospecific and binds or specifically binds to a single Fzd receptor, e.g., only one of Fzd1, Fzd2, Fzd3, Fzd4, Fzd5, Fzd6, Fzd7, Fzd8, Fzd9, or Fzd10.

In some embodiments, a monospecific Fzd binding region binds to a region of an Fzd receptor that does not include the cysteine rich domain (CRD) of the Fzd receptor, or includes less than the entire CRD of the FZD receptor. As illustrated in FIG. 3, sequences within the CRD show strong homology between the 10 Fzd receptors, with homologies being even higher between subfamily members. Accordingly, certain embodiments of the monospecific Fzd binding regions disclosed herein do not bind to the CRD, or bind only to a subset of the CRD.

In some embodiments, a Fzd binding region, e.g., a monospecific Fzd binding region, binds to an epitope comprising at least a portion of the extracellular domain after the CRD, referred to herein as the "hinge region" of a Fzd receptor (see FIG. 2A). In particular embodiments, at least 20%, at least 30%, at least 40%, at least 50%, at least 60%, at least 70%, at least 80%, at least 90%, or 100% of the epitope is present within the hinge region of a Fzd receptor.

As illustrated in FIG. 3, the hinge regions of the extracellular domain of Fzd receptors show highly divergent sequences. Sequences of illustrative Fzd receptor hinge regions are set forth in SEQ ID NOs: 1-10 and in Table 1 below. In certain embodiments, the hinge region includes an amino acid sequence having at least 90%, at least 95%, at least 98%, or at least 99% identity to any of the sequences set forth in SEQ ID NOs: 1-10.

TABLE 1

| Fzd hinge region sequences | | |
|---|---|---|
| SID NO: | Fzd | Hinge Region Sequence |
| 1 | Fzd1 | CVGQNTSDKGTPTPSLLPEFW TSNPQHGGGGHRGGFPGGAGA SERGKFSC |
| 2 | Fzd2 | CVGQNHSEDGAPALLTTAPPP GLQPGAGGTPGGPGGGGAPPR YATLEHPFHC |

TABLE 1-continued

Fzd hinge region sequences

| SID NO: | Fzd | Hinge Region Sequence |
|---|---|---|
| 3 | Fzd3 | CDEPYPRLVDLNLAGEPTEGA PVAVQRDYGFWC |
| 4 | Fzd4 | CMEGPGDEEVPLPHKTPIQPG EEC |
| 5 | Fzd5 | CMDYNRSEATTAPPRPFPAKP TLPGPPGAPASGGEC |
| 6 | Fzd6 | CDETVPVTFDPHTEFLGPQKK TEQVQRDIGFWC |
| 7 | Fzd7 | CVGQNTSDGSGGAGGSPTAYP TAPYLPDPPFTAMSPSDGRGR LSFPFSC |
| 8 | Fzd8 | CMDYNRTDLTTAAPSPPRRLP PPPPGEQPPSGSGHGRPPGAR PPHRGGGRGGGGDAAAPPAR GGGGGGKARPPGGGAAPC |
| 9 | Fzd9 | CMEAPENATAGPAEPHKGLGM LPVAPRPARPPGDLGPGAGGS GTC |
| 10 | Fzd10 | CMEAPNNGSDEPTRGSGLFPP LFRPQRPHSAQEHPLKDGGPG RGGC |

In some embodiments, a monospecific Fzd binding region binds to an epitope comprising at least a portion of an N-terminal region upstream of the CRD of the Fzd receptor (FIG. 1). In particular embodiments, at least 20%, at least 30%, at least 40%, at least 50%, at least 60%, at least 70%, at least 80%, at least 90%, or 100% of the epitope is present within the N-terminal region of a Fzd receptor.

In yet further embodiments, a monospecific Fzd binding region binds to an epitope comprising a portion of both the CRD and the hinge region (see Table 2, clones designated "ext"). In particular embodiments, at least 20%, at least 30%, at least 40%, at least 50%, at least 60%, at least 70%, at least 80%, at least 90%, or 100% of the epitope is present within the hinge region, while the remainder is within the CRD.

Immunological binding generally refers to the non-covalent interactions of the type which occur between an immunoglobulin molecule and an antigen for which the immunoglobulin is specific, for example by way of illustration and not limitation, as a result of electrostatic, ionic, hydrophilic and/or hydrophobic attractions or repulsion, steric forces, hydrogen bonding, van der Waals forces, and other interactions. The strength or affinity of immunological binding interactions can be expressed in terms of the dissociation constant $(K_D)$ of the interaction, wherein a smaller $K_D$ represents a greater affinity. Immunological binding properties of selected polypeptides can be quantified using methods well known in the art. One such method entails measuring the rates of antigen-binding site/antigen complex formation and dissociation, wherein those rates depend on the concentrations of the complex partners, the affinity of the interaction, and on geometric parameters that equally influence the rate in both directions. Thus, both the "on rate constant" $(K_{on})$ and the "off rate constant" $(K_{off})$ can be determined by calculation of the concentrations and the actual rates of association and dissociation. The ratio of $K_{off}/K_{on}$ enables cancellation of all parameters not related to affinity, and is thus equal to the dissociation constant $K_D$.

See, generally, Davies et al. (1990) *Annual Rev. Biochem.* 59:439-473. In certain embodiment, the anti-Fzd antibodies bind one Fzd receptor with a $K_D$ of less than or equal to about $1\times10^{-4}$ M, less than or equal to about $1\times10^{-5}$ M, less than or equal to about $1\times10^{-6}$ M, less than or equal to about $1\times10^{-7}$ M, less than or equal to about $1\times10^{-8}$ M, less than or equal to about $1\times10^{-9}$ M, or at least about $1\times10^{-10}$ M. In certain embodiments, the anti-Fzd antibodies described herein bind one Fzd receptor with a $K_D$ of less than about 10,000 nM, less than about 1000 nM, less than about 100 nM, less than about 10 nM, less than about 1 nM or less than about 0.1 nM, and in some embodiments, the antibodies may have even higher affinity for one Fzd receptor. In certain embodiments, the anti-Fzd antibodies described herein have an affinity $K_D$ of about 100, 150, 155, 160, 170, 175, 180, 185, 190, 191, 192, 193, 194, 195, 196, 197, 198 or 199 picomolar, and in some embodiments, the antibodies may have even higher affinity for one Fzd receptor.

An antibody or antigen-binding fragment thereof according to certain embodiments includes antibodies and antigen binding fragments thereof that compete for binding to one Fzd receptor with any antibody described herein which both (i) specifically binds to the one Fzd receptor and/or (ii) comprises a VH and/or VL domain (or a VH and/or VL CDR set) disclosed herein, or (iii) comprises a VH CDR3 disclosed herein, or a variant of any of these. Competition between antibodies may be assayed easily in vitro, for example using ELISA and/or by tagging a specific reporter molecule to one antibody which can be detected in the presence of other untagged antibodies, to enable identification of specific antibodies which bind the same epitope or an overlapping epitope. Thus, there is provided herein a specific antibody or antigen-binding fragment thereof, comprising a human antibody antigen-binding site which competes with an antibody described herein that binds to one Fzd receptor.

In this regard, as used herein, the terms "competes with", "inhibits binding" and "blocks binding" (e.g., referring to inhibition/blocking of binding of a Wnt to one Fzd receptor or referring to inhibition/blocking of binding of an anti-Fzd antibody to a Fzd receptor) are used interchangeably and encompass both partial and complete inhibition/blocking. The inhibition/blocking of a Wnt to one Fzd receptor preferably reduces or alters the normal level or type of cell signaling that occurs when the Wnt binds to the Fzd receptor without inhibition or blocking. Inhibition and blocking are also intended to include any measurable decrease in the binding of a Wnt to a Fzd receptor when in contact with an anti-Fzd antibody as disclosed herein as compared to the ligand not in contact with an anti-Fzd antibody, e.g., the blocking of binding of the Wnt to the Fzd receptor by at least about 10%, 20%, 30%, 40%, 50%, 60%, 65%, 70%, 75%, 80%, 85%, 90%, 91%, 92%, 93%, 94%, 95%, 96%, 97%, 98%, 99%, or 100%.

The constant regions of immunoglobulins show less sequence diversity than the variable regions, and are responsible for binding a number of natural proteins to elicit important biochemical events. In humans, there are five different classes of antibodies including IgA (which includes subclasses IgA1 and IgA2), IgD, IgE, IgG (which includes subclasses IgG1, IgG2, IgG3, and IgG4), and IgM. The distinguishing features between these antibody classes are their constant regions, although subtler differences may exist in the V region.

The Fc region of an antibody interacts with a number of Fc receptors and ligands, imparting an array of important functional capabilities referred to as effector functions. For IgG, the Fc region comprises Ig domains CH2 and CH3 and the N-terminal hinge leading into CH2. An important family of Fc receptors for the IgG class are the Fc gamma receptors (FcγRs). These receptors mediate communication between antibodies and the cellular arm of the immune system (Raghavan et al., 1996, Annu Rev Cell Dev Biol 12:181-220; Ravetch et al., 2001, Annu Rev Immunol 19:275-290). In humans this protein family includes FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIIb-NA1 and FcγRIIIb-NA2) (Jefferis et al., 2002, Immunol Lett 82:57-65). These receptors typically have an extracellular domain that mediates binding to Fc, a membrane spanning region, and an intracellular domain that may mediate some signaling event within the cell. These receptors are expressed in a variety of immune cells including monocytes, macrophages, neutrophils, dendritic cells, eosinophils, mast cells, platelets, B cells, large granular lymphocytes, Langerhans' cells, natural killer (NK) cells, and T cells. Formation of the Fc/FcγR complex recruits these effector cells to sites of bound antigen, typically resulting in signaling events within the cells and important subsequent immune responses such as release of inflammation mediators, B cell activation, endocytosis, phagocytosis, and cytotoxic attack.

The ability to mediate cytotoxic and phagocytic effector functions is a potential mechanism by which antibodies destroy targeted cells. The cell-mediated reaction wherein nonspecific cytotoxic cells that express FcγRs recognize bound antibody on a target cell and subsequently cause lysis of the target cell is referred to as antibody dependent cell-mediated cytotoxicity (ADCC) (Raghavan et al., 1996, Annu Rev Cell Dev Biol 12:181-220; Ghetie et al., 2000, Annu Rev Immunol 18:739-766; Ravetch et al., 2001, Annu Rev Immunol 19:275-290). The cell-mediated reaction wherein nonspecific cytotoxic cells that express FcγRs recognize bound antibody on a target cell and subsequently cause phagocytosis of the target cell is referred to as antibody dependent cell-mediated phagocytosis (ADCP). All FcγRs bind the same region on Fc, at the N-terminal end of the Cg2 (CH2) domain and the preceding hinge. This interaction is well characterized structurally (Sondermann et al., 2001, J Mol Biol 309:737-749), and several structures of the human Fc bound to the extracellular domain of human FcγRIIIb have been solved (pdb accession code 1E4K) (Sondermann et al., 2000, Nature 406:267-273.) (pdb accession codes 1IIS and 1IIX) (Radaev et al., 2001, J Biol Chem 276:16469-16477.)

The different IgG subclasses have different affinities for the FcγRs, with IgG1 and IgG3 typically binding substantially better to the receptors than IgG2 and IgG4 (Jefferis et al., 2002, Immunol Lett 82:57-65). All FcγRs bind the same region on IgG Fc, yet with different affinities: the high affinity binder FcγRI has a $K_d$ for IgG1 of $10$ $M^{-1}$, whereas the low affinity receptors FcγRII and FcγRIII generally bind at $10^{-6}$ and $10^{-5}$ respectively. The extracellular domains of FcγRIIIa and FcγRIIIb are 96% identical; however, FcγRIIIb does not have an intracellular signaling domain. Furthermore, whereas FcγRI, FcγRIIa/c, and FcγRIIIa are positive regulators of immune complex-triggered activation, characterized by having an intracellular domain that has an immunoreceptor tyrosine-based activation motif (ITAM), FcγRIIb has an immunoreceptor tyrosine-based inhibition motif (ITIM) and is therefore inhibitory. Thus the former are referred to as activation receptors, and FcγRIIb is referred to as an inhibitory receptor. The receptors also differ in expression pattern and levels on different immune cells. Yet another level of complexity is the existence of a number of FcγR polymorphisms in the human proteome. A particularly relevant polymorphism with clinical significance is V158/F158 FcγRIIIa. Human IgG1 binds with greater affinity to the V158 allotype than to the F158 allotype. This difference in affinity, and presumably its effect on ADCC and/or ADCP, has been shown to be a significant determinant of the efficacy of the anti-CD20 antibody rituximab (Rituxan®, a registered trademark of IDEC Pharmaceuticals Corporation). Subjects with the V158 allotype respond favorably to rituximab treatment; however, subjects with the lower affinity F158 allotype respond poorly (Cartron et al., 2002, Blood 99:754-758). Approximately 10-20% of humans are V158N158 homozygous, 45% are V158/F158 heterozygous, and 35-45% of humans are F158/F158 homozygous (Lehmbecher et al., 1999, Blood 94:4220-4232; Cartron et al., 2002, Blood 99:754-758). Thus 80-90% of humans are poor responders, that is, they have at least one allele of the F158 FcγRIIIa.

The Fc region is also involved in activation of the complement cascade. In the classical complement pathway, C1 binds with its C1q subunits to Fc fragments of IgG or IgM, which has formed a complex with antigen(s). In certain embodiments of the invention, modifications to the Fc region comprise modifications that alter (either enhance or decrease) the ability of a Fzd-specific antibody as described herein to activate the complement system (see e.g., U.S. Pat. No. 7,740,847). To assess complement activation, a complement-dependent cytotoxicity (CDC) assay may be performed (See, e.g., Gazzano-Santoro et al., J. Immunol. Methods, 202:163 (1996)).

Thus in certain embodiments, the present invention provides anti-Fzd antibodies having a modified Fc region with altered functional properties, such as reduced or enhanced CDC, ADCC, or ADCP activity, or enhanced binding affinity for a specific FcγR or increased serum half-life. Other modified Fc regions contemplated herein are described, for example, in issued U.S. Pat. Nos. 7,317,091; 7,657,380; 7,662,925; 6,538,124; 6,528,624; 7,297,775; 7,364,731; Published U.S. Applications US2009092599; US20080131435; US20080138344; and published International Applications WO2006/105338; WO2004/063351; WO2006/088494; WO2007/024249.

In certain embodiments, the Fc region may be derived from any of a variety of different Fcs, including but not limited to, a wild-type or modified IgG1, IgG2, IgG3, IgG4 or other isotype, e.g., wild-type or modified human IgG1, human IgG2, human IgG3, human IgG4, human IgG4Pro (comprising a mutation in core hinge region that prevents the formation of IgG4 half molecules), human IgA, human IgE, human IgM, or the modified IgG1 referred to as IgG1 LALAPG. The L235A, P329G (LALA-PG) variant has been shown to eliminate complement binding and fixation as well as Fcγdependent antibody-dependent cell-mediated cytotoxicity (ADCC) in both murine IgG2a and human IgG1. In particular embodiments of any of the IgG disclosed herein, the IgG comprises one or more of the following amino acid substitutions: N297G, N297A, N297E, L234A, L235A, or P236G.

Thus, in certain embodiments, antibody variable domains with the desired binding specificities are fused to immunoglobulin constant domain sequences. In certain embodiments, the fusion is with an Ig heavy chain constant domain, comprising at least part of the hinge, $C_H2$, and $C_H3$ regions.

It is preferred to have the first heavy-chain constant region ($C_H1$) containing the site necessary for light chain bonding, present in at least one of the fusions. DNAs encoding the immunoglobulin heavy chain fusions and, if desired, the immunoglobulin light chain, are inserted into separate expression vectors, and are co-transfected into a suitable host cell. This provides for greater flexibility in adjusting the mutual proportions of the three polypeptide fragments in embodiments when unequal ratios of the three polypeptide chains used in the construction provide the optimum yield of the desired bispecific antibody. It is, however, possible to insert the coding sequences for two or all three polypeptide chains into a single expression vector when the expression of at least two polypeptide chains in equal ratios results in high yields or when the ratios have no significant effect on the yield of the desired chain combination.

Antibodies of the present invention (and antigen-binding fragments and variants thereof) may also be modified to include an epitope tag or label, e.g., for use in purification or diagnostic applications. There are many linking groups known in the art for making antibody conjugates, including, for example, those disclosed in U.S. Pat. No. 5,208,020 or EP Patent 0 425 235 B1, and Chari et al., Cancer Research 52: 127-131 (1992). The linking groups include disulfide groups, thioether groups, acid labile groups, photolabile groups, peptidase labile groups, or esterase labile groups, as disclosed in the above-identified patents, disulfide and thioether groups being preferred.

In another contemplated embodiment, a Fzd-specific antibody or antigen-binding fragment thereof as described herein may be conjugated or operably linked to another therapeutic compound, referred to herein as a conjugate. The conjugate may be a cytotoxic agent, a chemotherapeutic agent, a cytokine, an anti-angiogenic agent, a tyrosine kinase inhibitor, a toxin, a radioisotope, or other therapeutically active agent. Chemotherapeutic agents, cytokines, anti-angiogenic agents, tyrosine kinase inhibitors, and other therapeutic agents have been described above, and all of these aforementioned therapeutic agents may find use as antibody conjugates.

Immunoconjugates may be made using a variety of bifunctional protein coupling agents such as N-succinimidyl-3-(2-pyidyldithio)propionate (SPDP), succinimidyl-4-(N-maleimidomethyl)cyclohexane-1-carboxylate, iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl)hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). Particular coupling agents include N-succinimidyl-3-(2-pyidyldithio) propionate (SPDP) (Carlsson et al., Biochem. J. 173:723-737 [1978]) and N-succinimidyl-4-(2-pyridylthio)pentanoate (SPP) to provide for a disulfide linkage. The linker may be a "cleavable linker" facilitating release of one or more cleavable components. For example, an acid-labile linker may be used (Cancer Research 52:127-131 (1992); U.S. Pat. No. 5,208,020).

In certain embodiments, anti-LRP5/6 antibodies and antigen-binding fragments thereof are monoclonal antibodies. In certain embodiments, they are humanized.

The present invention further provides in certain embodiments an isolated nucleic acid encoding an antibody or antigen-binding fragment thereof as described herein, for instance, a nucleic acid that codes for one or more CDR or VH or VL domain as described herein. Nucleic acids include DNA and RNA. These and related embodiments may include polynucleotides encoding antibodies that bind one Fzd receptors as described herein. The term "isolated polynucleotide" as used herein shall mean a polynucleotide of genomic, cDNA, or synthetic origin or some combination thereof, which by virtue of its origin the isolated polynucleotide (1) is not associated with all or a portion of a polynucleotide in which the isolated polynucleotide is found in nature, (2) is linked to a polynucleotide to which it is not linked in nature, or (3) does not occur in nature as part of a larger sequence.

The term "operably linked" means that the components to which the term is applied are in a relationship that allows them to carry out their inherent functions under suitable conditions. For example, a transcription control sequence "operably linked" to a protein coding sequence is ligated thereto so that expression of the protein coding sequence is achieved under conditions compatible with the transcriptional activity of the control sequences.

The term "control sequence" as used herein refers to polynucleotide sequences that can affect expression, processing or intracellular localization of coding sequences to which they are ligated or operably linked. The nature of such control sequences may depend upon the host organism. In particular embodiments, transcription control sequences for prokaryotes may include a promoter, ribosomal binding site, and transcription termination sequence. In other particular embodiments, transcription control sequences for eukaryotes may include promoters comprising one or a plurality of recognition sites for transcription factors, transcription enhancer sequences, transcription termination sequences and polyadenylation sequences. In certain embodiments, "control sequences" can include leader sequences and/or fusion partner sequences.

The term "polynucleotide" as referred to herein means single-stranded or double-stranded nucleic acid polymers. In certain embodiments, the nucleotides comprising the polynucleotide can be ribonucleotides or deoxyribonucleotides or a modified form of either type of nucleotide. Said modifications include base modifications such as bromouridine, ribose modifications such as arabinoside and 2',3'-dideoxyribose and internucleotide linkage modifications such as phosphorothioate, phosphorodithioate, phosphoroselenoate, phosphorodiselenoate, phosphoroanilothioate, phoshoraniladate and phosphoroamidate. The term "polynucleotide" specifically includes single and double stranded forms of DNA.

The term "naturally occurring nucleotides" includes deoxyribonucleotides and ribonucleotides. The term "modified nucleotides" includes nucleotides with modified or substituted sugar groups and the like. The term "oligonucleotide linkages" includes oligonucleotide linkages such as phosphorothioate, phosphorodithioate, phosphoroselenoate, phosphorodiselenoate, phosphoroanilothioate, phoshoraniladate, phosphoroamidate, and the like. See, e.g., LaPlanche et al., 1986, Nucl. Acids Res., 14:9081; Stec et al., 1984, J. Am. Chem. Soc., 106:6077; Stein et al., 1988, Nucl. Acids Res., 16:3209; Zon et al., 1991, Anti-Cancer Drug Design, 6:539; Zon et al., 1991, OLIGONUCLEOTIDES AND ANALOGUES: A PRACTICAL APPROACH, pp. 87-108 (F. Eckstein, Ed.), Oxford University Press, Oxford England; Stec et al., U.S. Pat. No. 5,151,510; Uhlmann and Peyman, 1990, Chemical Reviews, 90:543, the disclosures of which are hereby incorporated by reference for any purpose. An oligonucleotide can include a detectable label to enable detection of the oligonucleotide or hybridization thereof.

The term "vector" is used to refer to any molecule (e.g., nucleic acid, plasmid, or virus) used to transfer coding information to a host cell. The term "expression vector" refers to a vector that is suitable for transformation of a host cell and contains nucleic acid sequences that direct and/or control expression of inserted heterologous nucleic acid sequences. Expression includes, but is not limited to, processes such as transcription, translation, and RNA splicing, if introns are present.

As will be understood by those skilled in the art, polynucleotides may include genomic sequences, extra-genomic and plasmid-encoded sequences and smaller engineered gene segments that express, or may be adapted to express, proteins, polypeptides, peptides and the like. Such segments may be naturally isolated, or modified synthetically by the skilled person.

As will be also recognized by the skilled artisan, polynucleotides may be single-stranded (coding or antisense) or double-stranded, and may be DNA (genomic, cDNA or synthetic) or RNA molecules. RNA molecules may include HnRNA molecules, which contain introns and correspond to a DNA molecule in a one-to-one manner, and mRNA molecules, which do not contain introns. Additional coding or non-coding sequences may, but need not, be present within a polynucleotide according to the present disclosure, and a polynucleotide may, but need not, be linked to other molecules and/or support materials. Polynucleotides may comprise a native sequence or may comprise a sequence that encodes a variant or derivative of such a sequence.

Therefore, according to these and related embodiments, the present disclosure also provides polynucleotides encoding the anti-Fzd antibodies and antigen-binding fragments thereof described herein. In certain embodiments, polynucleotides are provided that comprise some or all of a polynucleotide sequence encoding an antibody or antigen-binding fragment thereof as described herein and complements of such polynucleotides.

It will be appreciated by those of ordinary skill in the art that, as a result of the degeneracy of the genetic code, there are many nucleotide sequences that encodes an antibody as described herein. Some of these polynucleotides bear minimal sequence identity to the nucleotide sequence of the native or original polynucleotide sequence that encode antibodies that bind to a Fzd receptor. Nonetheless, polynucleotides that vary due to differences in codon usage are expressly contemplated by the present disclosure. In certain embodiments, sequences that have been codon-optimized for mammalian expression are specifically contemplated.

Therefore, in another embodiment of the invention, a mutagenesis approach, such as site-specific mutagenesis, may be employed for the preparation of variants and/or derivatives of the antibodies described herein. By this approach, specific modifications in a polypeptide sequence can be made through mutagenesis of the underlying polynucleotides that encode them. These techniques provide a straightforward approach to prepare and test sequence variants, for example, incorporating one or more of the foregoing considerations, by introducing one or more nucleotide sequence changes into the polynucleotide.

Site-specific mutagenesis allows the production of mutants through the use of specific oligonucleotide sequences which encode the DNA sequence of the desired mutation, as well as a sufficient number of adjacent nucleotides, to provide a primer sequence of sufficient size and sequence complexity to form a stable duplex on both sides of the deletion junction being traversed. Mutations may be employed in a selected polynucleotide sequence to improve, alter, decrease, modify, or otherwise change the properties of the polynucleotide itself, and/or alter the properties, activity, composition, stability, or primary sequence of the encoded polypeptide.

In certain embodiments, the inventors contemplate the mutagenesis of the polynucleotide sequences that encode an antibody disclosed herein, or an antigen-binding fragment thereof, to alter one or more properties of the encoded polypeptide, such as the binding affinity of the antibody or the antigen-binding fragment thereof, or the function of a particular Fc region, or the affinity of the Fc region for a particular FcγR. The techniques of site-specific mutagenesis are well-known in the art, and are widely used to create variants of both polypeptides and polynucleotides. For example, site-specific mutagenesis is often used to alter a specific portion of a DNA molecule. In such embodiments, a primer comprising typically about 14 to about 25 nucleotides or so in length is employed, with about 5 to about 10 residues on both sides of the junction of the sequence being altered.

As will be appreciated by those of skill in the art, site-specific mutagenesis techniques have often employed a phage vector that exists in both a single stranded and double stranded form. Typical vectors useful in site-directed mutagenesis include vectors such as the M13 phage. These phages are readily commercially-available and their use is generally well-known to those skilled in the art. Double-stranded plasmids are also routinely employed in site directed mutagenesis that eliminates the step of transferring the gene of interest from a plasmid to a phage.

The preparation of sequence variants of the selected peptide-encoding DNA segments using site-directed mutagenesis provides a means of producing potentially useful species and is not meant to be limiting as there are other ways in which sequence variants of peptides and the DNA sequences encoding them may be obtained. For example, recombinant vectors encoding the desired peptide sequence may be treated with mutagenic agents, such as hydroxylamine, to obtain sequence variants. Specific details regarding these methods and protocols are found in the teachings of Maloy et al., 1994; Segal, 1976; Prokop and Bajpai, 1991; Kuby, 1994; and Maniatis et al., 1982, each incorporated herein by reference, for that purpose.

In many embodiments, the nucleic acids encoding a subject monoclonal antibody are introduced directly into a host cell, and the cell incubated under conditions sufficient to induce expression of the encoded antibody. The antibodies of this disclosure are prepared using standard techniques well known to those of skill in the art in combination with the polypeptide and nucleic acid sequences provided herein. The polypeptide sequences may be used to determine appropriate nucleic acid sequences encoding the particular antibody disclosed thereby. The nucleic acid sequence may be optimized to reflect particular codon "preferences" for various expression systems according to standard methods well known to those of skill in the art.

According to certain related embodiments there is provided a recombinant host cell which comprises one or more constructs as described herein; a nucleic acid encoding any antibody, CDR, VH or VL domain, or antigen-binding fragment thereof; and a method of production of the encoded product, which method comprises expression from encoding nucleic acid therefor. Expression may conveniently be achieved by culturing under appropriate conditions recombinant host cells containing the nucleic acid. Following production by expression, an antibody or antigen-binding fragment thereof, may be isolated and/or purified using any suitable technique, and then used as desired.

Antibodies or antigen-binding fragments thereof as provided herein, and encoding nucleic acid molecules and vectors, may be isolated and/or purified, e.g. from their natural environment, in substantially pure or homogeneous form, or, in the case of nucleic acid, free or substantially free of nucleic acid or genes of origin other than the sequence encoding a polypeptide with the desired function. Nucleic acid may comprise DNA or RNA and may be wholly or partially synthetic. Reference to a nucleotide sequence as set out herein encompasses a DNA molecule with the specified sequence, and encompasses a RNA molecule with the specified sequence in which U is substituted for T, unless context requires otherwise.

Systems for cloning and expression of a polypeptide in a variety of different host cells are well known. Suitable host cells include bacteria, mammalian cells, yeast and baculovirus systems. Mammalian cell lines available in the art for expression of a heterologous polypeptide include Chinese hamster ovary cells, HeLa cells, baby hamster kidney cells, NSO mouse melanoma cells and many others. A common, preferred bacterial host is *E. coli.*

The expression of antibodies and antigen-binding fragments thereof in prokaryotic cells such as *E. coli* is well established in the art. For a review, see for example Pluckthun, A. Bio/Technology 9: 545-551 (1991). Expression in eukaryotic cells in culture is also available to those skilled in the art as an option for production of antibodies or antigen-binding fragments thereof, see recent reviews, for example Ref, M. E. (1993) Curr. Opinion Biotech. 4: 573-576; Trill J. J. et al. (1995) Curr. Opinion Biotech 6: 553-560.

Suitable vectors can be chosen or constructed, containing appropriate regulatory sequences, including promoter sequences, terminator sequences, polyadenylation sequences, enhancer sequences, marker genes and other sequences as appropriate. Vectors may be plasmids, viral e.g. phage, or phagemid, as appropriate. For further details see, for example, Molecular Cloning: a Laboratory Manual: 2nd edition, Sambrook et al., 1989, Cold Spring Harbor Laboratory Press. Many known techniques and protocols for manipulation of nucleic acid, for example in preparation of nucleic acid constructs, mutagenesis, sequencing, introduction of DNA into cells and gene expression, and analysis of proteins, are described in detail in Current Protocols in Molecular Biology, Second Edition, Ausubel et al. eds., John Wiley & Sons, 1992, or subsequent updates thereto.

The term "host cell" is used to refer to a cell into which has been introduced, or which is capable of having introduced into it, a nucleic acid sequence encoding one or more of the herein described antibodies, and which further expresses or is capable of expressing a selected gene of interest, such as a gene encoding any herein described antibody. The term includes the progeny of the parent cell, whether or not the progeny are identical in morphology or in genetic make-up to the original parent, so long as the selected gene is present. Accordingly there is also contemplated a method comprising introducing such nucleic acid into a host cell. The introduction may employ any available technique. For eukaryotic cells, suitable techniques may include calcium phosphate transfection, DEAE-Dextran, electroporation, liposome-mediated transfection and transduction using retrovirus or other virus, e.g. vaccinia or, for insect cells, baculovirus. For bacterial cells, suitable techniques may include calcium chloride transformation, electroporation and transfection using bacteriophage. The introduction may be followed by causing or allowing expression from the nucleic acid, e.g. by culturing host cells under conditions for expression of the gene. In one embodiment, the nucleic acid is integrated into the genome (e.g. chromosome) of the host cell. Integration may be promoted by inclusion of sequences which promote recombination with the genome, in accordance-with standard techniques.

The present invention also provides, in certain embodiments, a method which comprises using a construct as stated above in an expression system in order to express a particular polypeptide such as a Fzd-specific antibody as described herein. The term "transduction" is used to refer to the transfer of genes from one bacterium to another, usually by a phage. "Transduction" also refers to the acquisition and transfer of eukaryotic cellular sequences by retroviruses. The term "transfection" is used to refer to the uptake of foreign or exogenous DNA by a cell, and a cell has been "transfected" when the exogenous DNA has been introduced inside the cell membrane. A number of transfection techniques are well known in the art and are disclosed herein. See, e.g., Graham et al., 1973, Virology 52:456; Sambrook et al., 2001, MOLECULAR CLONING, A LABORATORY MANUAL; Cold Spring Harbor Laboratories; Davis et al., 1986, BASIC METHODS IN MOLECULAR BIOLOGY, Elsevier; and Chu et al., 1981, Gene 13:197. Such techniques can be used to introduce one or more exogenous DNA moieties into suitable host cells.

The term "transformation" as used herein refers to a change in a cell's genetic characteristics, and a cell has been transformed when it has been modified to contain a new DNA. For example, a cell is transformed where it is genetically modified from its native state. Following transfection or transduction, the transforming DNA may recombine with that of the cell by physically integrating into a chromosome of the cell, or may be maintained transiently as an episomal element without being replicated, or may replicate independently as a plasmid. A cell is considered to have been stably transformed when the DNA is replicated with the division of the cell. The term "naturally occurring" or "native" when used in connection with biological materials such as nucleic acid molecules, polypeptides, host cells, and the like, refers to materials which are found in nature and are not manipulated by a human. Similarly, "non-naturally occurring" or "non-native" as used herein refers to a material that is not found in nature or that has been structurally modified or synthesized by a human.

The terms "polypeptide" "protein" and "peptide" and "glycoprotein" are used interchangeably and mean a polymer of amino acids not limited to any particular length. The term does not exclude modifications such as myristylation, sulfation, glycosylation, phosphorylation and addition or deletion of signal sequences. The terms "polypeptide" or "protein" means one or more chains of amino acids, wherein each chain comprises amino acids covalently linked by peptide bonds, and wherein said polypeptide or protein can comprise a plurality of chains non-covalently and/or covalently linked together by peptide bonds, having the sequence of native proteins, that is, proteins produced by naturally-occurring and specifically non-recombinant cells, or genetically-engineered or recombinant cells, and comprise molecules having the amino acid sequence of the native protein, or molecules having deletions from, additions to, and/or substitutions of one or more amino acids of the native sequence. The terms "polypeptide" and "protein" specifically encompass the antibodies that bind to a Fzd receptor of the present disclosure, or sequences that have deletions from, additions to, and/or substitutions of one or more amino acid of an anti-Fzd antibody. Thus, a "polypeptide" or a "protein" can comprise one (termed "a monomer") or a plurality (termed "a multimer") of amino acid chains.

The term "isolated protein" or "isolated antibody" referred to herein means that a subject protein or antibody is (1) is free of at least some other proteins with which it would typically be found in nature, (2) is essentially free of other proteins from the same source, e.g., from the same species, (3) is expressed by a cell from a different species, (4) has been separated from at least about 50 percent of polynucleotides, lipids, carbohydrates, or other materials with which it is associated in nature, (5) is not associated (by covalent or noncovalent interaction) with portions of a protein with which the "isolated protein" is associated in nature, (6) is operably associated (by covalent or noncovalent interaction) with a polypeptide with which it is not associated in nature, or (7) does not occur in nature. Such an isolated protein can be encoded by genomic DNA, cDNA, mRNA or other RNA, of may be of synthetic origin, or any combination thereof. In certain embodiments, the isolated protein is substantially free from proteins or polypeptides or other contaminants that are found in its natural environment that would interfere with its use (therapeutic, diagnostic, prophylactic, research or otherwise).

Amino acid sequence modification(s) of the antibodies described herein are contemplated. For example, it may be desirable to improve the binding affinity and/or other biological properties of the antibody. For example, amino acid sequence variants of an antibody may be prepared by introducing appropriate nucleotide changes into a polynucleotide that encodes the antibody, or a chain thereof, or by peptide synthesis. Such modifications include, for example, deletions from, and/or insertions into and/or substitutions of, residues within the amino acid sequences of the antibody. Any combination of deletion, insertion, and substitution may be made to arrive at the final antibody, provided that the final construct possesses the desired characteristics (e.g., high affinity binding to one Fzd receptor). The amino acid changes also may alter post-translational processes of the antibody, such as changing the number or position of glycosylation sites. Any of the variations and modifications described above for polypeptides of the present invention may be included in antibodies of the present invention.

The present disclosure provides variants of the antibodies and antigen-binding fragments thereof disclosed herein. In certain embodiments, such variant antibodies or antigen-binding fragments, or CDRs thereof, bind to one Fzd receptor at least about 50%, at least about 70%, and in certain embodiments, at least about 90% as well as an antibody sequence specifically set forth herein. In further embodiments, such variant antibodies or antigen-binding fragments, or CDRs thereof, bind to one Fzd receptor with greater affinity than the antibodies set forth herein, for example, that bind quantitatively at least about 105%, 106%, 107%, 108%, 109%, or 110% as well as an antibody sequence specifically set forth herein.

In particular embodiments, the antibody or antigen-binding fragment thereof, e.g., a Fab, scFv, VHH or sdAb, or Wnt surrogate, may comprise: a) a heavy chain variable region comprising: i. a CDR1 region that is identical in amino acid sequence to the heavy chain CDR1 region of a selected antibody described herein; ii. a CDR2 region that is identical in amino acid sequence to the heavy chain CDR2 region of the selected antibody; and iii. a CDR3 region that is identical in amino acid sequence to the heavy chain CDR3 region of the selected antibody; and/or b) a light chain variable domain comprising: i. a CDR1 region that is identical in amino acid sequence to the light chain CDR1 region of the selected antibody; ii. a CDR2 region that is identical in amino acid sequence to the light chain CDR2 region of the selected antibody; and iii. a CDR3 region that is identical in amino acid sequence to the light chain CDR3 region of the selected antibody; wherein the antibody specifically binds a selected target (e.g., one Fzd receptors). In a further embodiment, the antibody, or antigen-binding fragment thereof, is a variant antibody or antigen-binding fragment thereof wherein the variant comprises a heavy and light chain identical to the selected antibody except for up to 8, 9, 10, 11, 12, 13, 14, 15, or more amino acid substitutions in the CDR regions of the VH and VL regions. In this regard, there may be 1, 2, 3, 4, 5, 6, 7, 8, or in certain embodiments, 9, 10, 11, 12, 13, 14, 15 more amino acid substitutions in the CDR regions of the selected antibody. Substitutions may be in CDRs either in the VH and/or the VL regions. (See e.g., Muller, 1998, Structure 6:1153-1167).

In particular embodiments, a subject antibody or antigen-binding fragments thereof, e.g., a Fab, scFv, VHH or sdAb, or Wnt surrogate, may have: a) a heavy chain variable region having an amino acid sequence that is at least 80% identical, at least 95% identical, at least 90%, at least 95% or at least 98% or 99% identical, to the heavy chain variable region of an anti-Fzd antibody or antigen-binding fragments thereof described herein; and/or b) a light chain variable region having an amino acid sequence that is at least 80% identical, at least 85%, at least 90%, at least 95% or at least 98% or 99% identical, to the light chain variable region of an anti-Fzd antibody or antigen-binding fragments thereof described herein. The amino acid sequences of illustrative antigen-binding fragments thereof are set forth herein.

In particular embodiments, the antibody or antigen-binding fragment thereof, e.g., a Fab, scFv, VHH or sdAb, or Wit surrogate, may comprise one, two or more, three or more, four or more, five or more, or six of the CDRs identified in Table 1 for any particular antibody.

A polypeptide has a certain percent "sequence identity" to another polypeptide, meaning that, when aligned, that percentage of amino acids are the same when comparing the two sequences. Sequence similarity can be determined in a number of different manners. To determine sequence identity, sequences can be aligned using the methods and computer programs, including BLAST, available over the world wide web at ncbi.nlm.nih.gov/BLAST/. Another alignment algorithm is FASTA, available in the Genetics Computing Group (GCG) package, from Madison, Wis., USA, a wholly owned subsidiary of Oxford Molecular Group, Inc. Other techniques for alignment are described in Methods in Enzymology, vol. 266: Computer Methods for Macromolecular Sequence Analysis (1996), ed. Doolittle, Academic Press, Inc., a division of Harcourt Brace & Co., San Diego, Calif., USA. Of particular interest are alignment programs that permit gaps in the sequence. The Smith-Waterman is one type of algorithm that permits gaps in sequence alignments. See Meth. Mol. Biol. 70: 173-187 (1997). Also, the GAP program using the Needleman and Wunsch alignment method can be utilized to align sequences. See J. Mol. Biol. 48: 443-453 (1970)

Of interest is the BestFit program using the local homology algorithm of Smith and Waterman (Advances in Applied Mathematics 2: 482-489 (1981) to determine sequence identity. The gap generation penalty will generally range from 1 to 5, usually 2 to 4 and in many embodiments will be 3. The gap extension penalty will generally range from about 0.01 to 0.20 and in many instances will be 0.10. The program has default parameters determined by the sequences inputted to be compared. Preferably, the sequence identity is determined using the default parameters determined by the program. This program is available also from Genetics Computing Group (GCG) package, from Madison, Wis., USA.

Another program of interest is the FastDB algorithm. FastDB is described in Current Methods in Sequence Comparison and Analysis, Macromolecule Sequencing and Synthesis, Selected Methods and Applications, pp. 127-149, 1988, Alan R. Liss, Inc. Percent sequence identity is calculated by FastDB based upon the following parameters: Mismatch Penalty: 1.00; Gap Penalty: 1.00; Gap Size Penalty: 0.33; and Joining Penalty: 30.0.

In particular embodiments, the antibody may comprise: a) a heavy chain variable region comprising: i. a CDR1 region that is identical in amino acid sequence to the heavy chain CDR1 region of a selected antibody described herein; ii. a CDR2 region that is identical in amino acid sequence to the heavy chain CDR2 region of the selected antibody; and iii. a CDR3 region that is identical in amino acid sequence to the heavy chain CDR3 region of the selected antibody; and b) a light chain variable domain comprising: i. a CDR1 region that is identical in amino acid sequence to the light chain CDR1 region of the selected antibody; ii. a CDR2 region that is identical in amino acid sequence to the light chain CDR2 region of the selected antibody; and iii. a CDR3 region that is identical in amino acid sequence to the light chain CDR3 region of the selected antibody; wherein the antibody specifically binds a selected target (e.g., Fzd receptor, such as Fzd1). In a further embodiment, the antibody, or antigen-binding fragment thereof, is a variant antibody wherein the variant comprises a heavy and light chain identical to the selected antibody except for up to 8, 9, 10, 11, 12, 13, 14, 15, or more amino acid substitutions in the CDR regions of the VH and VL regions. In this regard, there may be 1, 2, 3, 4, 5, 6, 7, 8, or in certain embodiments, 9, 10, 11, 12, 13, 14, 15 more amino acid substitutions in the CDR regions of the selected antibody. Substitutions may be in CDRs either in the VH and/or the VL regions. (See e.g., Muller, 1998, Structure 6:1153-1167).

Determination of the three-dimensional structures of representative polypeptides (e.g., variant Fzd-specific antibodies as provided herein, for instance, an antibody protein having an antigen-binding fragment as provided herein) may be made through routine methodologies such that substitution, addition, deletion or insertion of one amino acids with selected natural or non-natural amino acids can be virtually modeled for purposes of determining whether a so derived structural variant retains the space-filling properties of presently disclosed species. See, for instance, Donate et al., 1994 *Prot. Sci.* 3:2378; Bradley et al., *Science* 309: 1868-1871 (2005); Schueler-Furman et al., *Science* 310:638 (2005); Dietz et al., *Proc. Nat. Acad. Sci. USA* 103:1244 (2006); Dodson et al., *Nature* 450:176 (2007); Qian et al., *Nature* 450:259 (2007); Raman et al. *Science* 327:1014-1018 (2010). Some additional non-limiting examples of computer algorithms that may be used for these and related embodiments, such as for rational design of Fzd-specific antibodies antigen-binding domains thereof as provided herein, include VMD which is a molecular visualization program for displaying, animating, and analyzing large biomolecular systems using 3-D graphics and built-in scripting (see the website for the Theoretical and Computational Biophysics Group, University of Illinois at Urbana-Champagne, at ks.uiuc.edu/Research/vmd/. Many other computer programs are known in the art and available to the skilled person and which allow for determining atomic dimensions from space-filling models (van der Waals radii) of energy-minimized conformations; GRID, which seeks to determine regions of high affinity for different chemical groups, thereby enhancing binding, Monte Carlo searches, which calculate mathematical alignment, and CHARMM (Brooks et al. (1983) *J. Comput. Chem.* 4:187-217) and AMBER (Weiner et al (1981) *J. Comput. Chem.* 106: 765), which assess force field calculations, and analysis (see also, Eisenfield et al. (1991) *Am. J. Physiol.* 261:C376-386; Lybrand (1991) *J. Pharm. Belg.* 46:49-54; Froimowitz (1990) *Biotechniques* 8:640-644; Burbam et al. (1990) *Proteins* 7:99-111; Pedersen (1985) *Environ. Health Perspect.* 61:185-190; and Kini et al. (1991) *J. Biomol. Struct. Dyn.* 9:475-488). A variety of appropriate computational computer programs are also commercially available, such as from Schrödinger (Munich, Germany).

In particular embodiments, the disclosure provides antibodies or antigen-binding fragments thereof that bind to a region of one Fzd receptor at points described in Table 4.

The disclosure also provides antibodies and antigen-binding fragments thereof that bind to one Frizzled receptor at specific contact points, including any of those disclosed in Table 4, which indicates specific sets of contact points for binding of various anti-Fzd antibodies or fragments thereof.

In another embodiment of invention, the anti-Fzd antibodies and humanized versions thereof are derived from rabbit monoclonal antibodies, and in particular are generated using RabMAb® technology. These antibodies are advantageous as they require minimal sequence modifications, thereby facilitating retention of functional properties after humanization using mutational lineage guided (MLG) humanization technology (see e.g., U.S. Pat. No. 7,462,697). Thus, illustrative methods for making the anti-Fzd antibodies of the present disclosure include the RabMab® rabbit monoclonal antibody technology described, for example, in U.S. Pat. Nos. 5,675,063 and 7,429,487. In this regard, in certain embodiments, the anti-Fzd antibodies of the disclosure are produced in rabbits. In particular embodiments, a rabbit-derived immortal B-lymphocyte capable of fusion with a rabbit splenocyte is used to produce a hybrid cell that produces an antibody. The immortal B-lymphocyte does not detectably express endogenous immunoglobulin heavy chain and may contain, in certain embodiments, an altered immunoglobulin heavy chain-encoding gene.

Compositions

Pharmaceutical compositions comprising an anti-Fzd antibody or antigen-binding fragment thereof, e.g., a Wnt surrogate, described herein and one or more pharmaceutically acceptable diluent, carrier, or excipient are also disclosed. In particular embodiments, the pharmaceutical composition further comprises one or more Wnt polypeptides or Norrin polypeptides.

In further embodiments, pharmaceutical compositions comprising a polynucleotide comprising a nucleic acid sequence encoding an anti-Fzd antibody or antigen-binding fragment thereof, e.g., a Wnt surrogate, described herein and one or more pharmaceutically acceptable diluent, carrier, or excipient are also disclosed. In particular embodiments, the pharmaceutical composition further comprises one or more polynucleotides comprising a nucleic acid sequence encoding a Wnt polypeptide or Norrin polypeptide. In certain embodiments, the polynucleotides are DNA or mRNA, e.g., a modified mRNA. In particular embodiments, the polynucleotides are modified mRNAs further comprising a 5' cap sequence and/or a 3' tailing sequence, e.g., a polyA tail. In other embodiments, the polynucleotides are expression cassettes comprising a promoter operatively linked to the coding sequences. In certain embodiments, the nucleic acid sequence encoding the anti-Fzd antibody or antigen-binding fragment thereof, e.g., a Wnt surrogate, and the nucleic acid sequence encoding the Wnt polypeptide or Norrin polypeptide are present in the same polynucleotide.

In further embodiments, pharmaceutical compositions comprising an expression vector, e.g., a viral vector, comprising a polynucleotide comprising a nucleic acid sequence encoding an anti-Fzd antibody or antigen-binding fragment thereof, e.g., a Wnt surrogate, described herein and one or more pharmaceutically acceptable diluent, carrier, or excipient are also disclosed. In particular embodiments, the pharmaceutical composition further comprises an expression vector, e.g., a viral vector, comprising a polynucleotide comprising a nucleic acid sequence encoding a Wnt polypeptide or Norrin polypeptide. In certain embodiments, the nucleic acid sequence encoding the anti-Fzd antibody or antigen-binding fragment thereof, e.g., a Wnt surrogate, and the nucleic acid sequence encoding the Wnt polypeptide or Norrin polypeptide are present in the same polynucleotide, e.g., expression cassette.

The present invention further contemplates a pharmaceutical composition comprising a cell comprising an expression vector comprising a polynucleotide comprising a promoter operatively linked to a nucleic acid encoding an anti-Fzd antibody or antigen-binding fragment thereof described herein and one or more pharmaceutically acceptable diluent, carrier, or excipient. In particular embodiments, the pharmaceutical composition further comprises a cell comprising an expression vector comprising a polynucleotide comprising a promoter operatively linked to a nucleic acid sequence encoding a Wnt polypeptide or a Norrin polypeptide. In certain embodiments, the nucleic acid sequence encoding the anti-Fzd antibody or antigen-binding fragment thereof, e.g., a Wnt surrogate, and the nucleic acid sequence encoding the Wnt polypeptide or Norrin polypeptide are present in the same polynucleotide, e.g., expression cassette and/or in the same cell. In particular embodiments, the cell is a heterologous cell or an autologous cell obtained from the subject to be treated. In particular embodiments, the cell is a stem cell, e.g., an adipose-derived stem cell or a hematopoietic stem cell.

The present disclosure contemplates pharmaceutical compositions comprising a first molecule for delivery of anti-Fzd antibody or antigen-binding fragment thereof, e.g., a Wnt surrogate, as a first active agent and a second molecule for delivery of a Wnt polypeptide or Norrin polypeptide. The first and second molecule may be the same type of molecule or different types of molecules. For example, in certain embodiments, the first and second molecule may each be independently selected from the following types of molecules: polypeptides, small organic molecules, nucleic acids encoding the first or second active agent (optionally DNA or mRNA, optionally modified RNA), vectors comprising a nucleic acid sequence encoding the first or second active agent (optionally expression vectors or viral vectors), and cells comprising a nucleic acid sequence encoding the first or second active agent (optionally an expression cassette).

The subject molecules, alone or in combination, can be combined with pharmaceutically-acceptable carriers, diluents, excipients and reagents useful in preparing a formulation that is generally safe, non-toxic, and desirable, and includes excipients that are acceptable for mammalian, e.g., human or primate, use. Such excipients can be solid, liquid, semisolid, or, in the case of an aerosol composition, gaseous.

Examples of such carriers, diluents and excipients include, but are not limited to, water, saline, Ringer's solutions, dextrose solution, and 5% human serum albumin. Supplementary active compounds can also be incorporated into the formulations. Solutions or suspensions used for the formulations can include a sterile diluent such as water for injection, saline solution, fixed oils, polyethylene glycols, glycerine, propylene glycol or other synthetic solvents; antibacterial compounds such as benzyl alcohol or methyl parabens; antioxidants such as ascorbic acid or sodium bisulfite; chelating compounds such as ethylenediaminetetraacetic acid (EDTA); buffers such as acetates, citrates or phosphates; detergents such as Tween 20 to prevent aggregation; and compounds for the adjustment of tonicity such as sodium chloride or dextrose. The pH can be adjusted with acids or bases, such as hydrochloric acid or sodium hydroxide. In particular embodiments, the pharmaceutical compositions are sterile.

Pharmaceutical compositions may further include sterile aqueous solutions or dispersions and sterile powders for the extemporaneous preparation of sterile injectable solutions or dispersion. For intravenous administration, suitable carriers include physiological saline, bacteriostatic water, or phosphate buffered saline (PBS). In some cases, the composition is sterile and should be fluid to allow it to be drawn into a syringe and provided to a subject using a syringe. In certain embodiments, it is stable under the conditions of manufacture and storage and is preserved against the contaminating action of microorganisms such as bacteria and fungi. The carrier can be, e.g., a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, sodium chloride in the composition. Prolonged absorption of the internal compositions can be brought about by including in the composition an agent which delays absorption, for example, aluminum monostearate and gelatin.

Sterile solutions can be prepared by incorporating the anti-Fzd antibody or antigen-binding fragment thereof (or encoding polynucleotide or cell comprising the same) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

In one embodiment, the pharmaceutical compositions are prepared with carriers that will protect the antibody or antigen-binding fragment thereof against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially. Liposomal suspensions can also be used as pharmaceutically acceptable carriers. These can be prepared according to methods known to those skilled in the art.

It may be advantageous to formulate the pharmaceutical compositions in dosage unit form for ease of administration and uniformity of dosage. Dosage unit form as used herein refers to physically discrete units suited as unitary dosages for the subject to be treated; each unit containing a predetermined quantity of active antibody or antigen-binding fragment thereof calculated to produce the desired therapeutic effect in association with the required pharmaceutical carrier. The specification for the dosage unit forms are dictated by and directly dependent on the unique characteristics of the antibody or antigen-binding fragment thereof and the particular therapeutic effect to be achieved, and the limitations inherent in the art of compounding such an active antibody or antigen-binding fragment thereof for the treatment of individuals.

The pharmaceutical compositions can be included in a container, pack, or dispenser, e.g. syringe, e.g. a prefilled syringe, together with instructions for administration.

The pharmaceutical compositions of the invention encompass any pharmaceutically acceptable salts, esters, or salts of such esters, or any other compound which, upon administration to an animal comprising a human, is capable of providing (directly or indirectly) the biologically active antibody or antigen-binding fragment thereof.

The present invention includes pharmaceutically acceptable salts of the anti-Fzd antibodies or antigen-binding fragments thereof, e.g., Wnt surrogates, described herein. The term "pharmaceutically acceptable salt" refers to physiologically and pharmaceutically acceptable salts of the compounds of the invention: i.e., salts that retain the desired biological activity of the parent compound and do not impart undesired toxicological effects thereto. A variety of pharmaceutically acceptable salts are known in the art and described, e.g., in "Remington's Pharmaceutical Sciences", 17th edition, Alfonso R. Gennaro (Ed.), Mark Publishing Company, Easton, Pa., USA, 1985 (and more recent editions thereof), in the "Encyclopedia of Pharmaceutical Technology", 3rd edition, James Swarbrick (Ed.), Informa Healthcare USA (Inc.), NY, USA, 2007, and in J. Pharm. Sci. 66: 2 (1977). Also, for a review on suitable salts, see "Handbook of Pharmaceutical Salts: Properties, Selection, and Use" by Stahl and Wermuth (Wiley-VCH, 2002).

Pharmaceutically acceptable base addition salts are formed with metals or amines, such as alkali and alkaline earth metals or organic amines. Metals used as cations comprise sodium, potassium, magnesium, calcium, and the like. Amines comprise N—N'-dibenzylethylenediamine, chloroprocaine, choline, diethanolamine, dicyclohexylamine, ethylenediamine, N-methylglucamine, and procaine (see, for example, Berge et al., "Pharmaceutical Salts," J. Pharma Sci., 1977, 66, 119). The base addition salts of said acidic compounds are prepared by contacting the free acid form with a sufficient amount of the desired base to produce the salt in the conventional manner. The free acid form may be regenerated by contacting the salt form with an acid and isolating the free acid in the conventional manner. The free acid forms differ from their respective salt forms somewhat in certain physical properties such as solubility in polar solvents, but otherwise the salts are equivalent to their respective free acid for purposes of the present invention.

In some embodiments, the pharmaceutical composition provided herein comprise a therapeutically effective amount of an anti-Fzd antibody or antigen-binding fragment thereof, e.g., a Wnt surrogate, described herein in admixture with a pharmaceutically acceptable carrier, diluent and/or excipient, for example saline, phosphate buffered saline, phosphate and amino acids, polymers, polyols, sugar, buffers, preservatives and other proteins. Exemplary amino acids, polymers and sugars and the like are octylphenoxy polyethoxy ethanol compounds, polyethylene glycol monostearate compounds, polyoxyethylene sorbitan fatty acid esters, sucrose, fructose, dextrose, maltose, glucose, mannitol, dextran, sorbitol, inositol, galactitol, xylitol, lactose, trehalose, bovine or human serum albumin, citrate, acetate, Ringer's and Hank's solutions, cysteine, arginine, carnitine, alanine, glycine, lysine, valine, leucine, polyvinylpyrrolidone, polyethylene and glycol. Preferably, this formulation is stable for at least six months at 4° C.

In some embodiments, the pharmaceutical composition provided herein comprises a buffer, such as phosphate buffered saline (PBS) or sodium phosphate/sodium sulfate, tris buffer, glycine buffer, sterile water and other buffers known to the ordinarily skilled artisan such as those described by Good et al. (1966) Biochemistry 5:467. The pH of the buffer may be in the range of 6.5 to 7.75, preferably 7 to 7.5, and most preferably 7.2 to 7.4.

Methods of Use

The present disclosure also provides methods for using the Fzd-specific antibodies, antigen-binding fragments thereof, e.g., Wnt surrogates, disclosed herein, e.g., to modulate a Wnt signaling pathway, e.g., to increase or decrease Wnt signaling, and the administration of Fzd-specific antibodies, antigen-binding fragments thereof, and Wnt surrogates disclosed herein in a variety of therapeutic settings. Provided herein are methods of treatment using the antibodies that bind one Fzd receptors or antigen-binding fragments thereof. In one embodiment, an antibody, or antigen-binding fragment thereof, of the present invention is provided to a subject having a disease involving inappropriate or deregulated Wnt signaling, e.g., increased or reduced Wnt signaling.

Increasing Wnt Pathway Signaling and Related Therapeutic Methods

In certain embodiments, an anti-Fzd antibody or antigen-binding fragment thereof, e.g., a Wnt surrogate, may be used to increase Wnt signaling in a tissue or cell. Thus, in some aspects, the present invention provides a method for increasing Wnt signaling or enhancing Wnt signaling in a tissue or cell, comprising contacting the tissue or cell with an effective amount of an anti-Fzd antibody or antigen-binding fragment thereof, e.g., a Wnt surrogate, disclosed herein, wherein the anti-Fzd antibody or antigen-binding fragment thereof is a Wnt signaling pathway agonist. In some embodiments, contacting occurs in vitro, ex vivo, or in vivo. In particular embodiments, the cell is a cultured cell, and the contacting occurs in vitro. In certain embodiments, the method comprises further contacting the tissue or cell with one or more Wnt polypeptides or Norrin polypeptides.

In related aspects, the present invention provides a method for increasing Wnt signaling in a tissue or cell, comprising contacting the tissue or cell with an effective amount of a polynucleotide comprising an anti-Fzd antibody or antigen-binding fragment thereof, e.g., a Wnt surrogate, of the present invention. In certain embodiments, the target tissue or cell is also contacted with a polynucleotide comprising a nucleic acid sequence that encodes a Wnt polypeptide or a Norrin polypeptide. In certain embodiments, the polynucleotides are DNA or mRNA, e.g., a modified mRNA. In particular embodiments, the polynucleotides are modified mRNAs further comprising a 5' cap sequence and/or a 3' tailing sequence, e.g., a polyA tail. In other embodiments, the polynucleotides are expression cassettes comprising a promoter operatively linked to the coding sequences. In certain embodiments, the nucleic acid sequence encoding the anti-Fzd antibody or antigen-binding fragment thereof, e.g., a Wnt surrogate, and the nucleic acid sequence encoding the Wnt polypeptide or Norrin polypeptide are present in the same polynucleotide.

In related aspects, the present invention provides a method for increasing Wnt signaling in a tissue or cell, comprising contacting the tissue or cell with an effective amount of a vector comprising a nucleic acid sequence encoding an anti-Fzd antibody or antigen-binding fragment thereof, e.g., a Wnt surrogate. In certain embodiments, the tissue or cell is also contacted with a vector comprising a nucleic acid sequence that encodes a Wnt polypeptide or a Norrin polypeptide. In certain embodiments, the vector is an expression vector, and may comprise a promoter operatively linked to the nucleic acid sequence. In particular embodiments, the vector is a viral vector. In certain embodiments, the nucleic acid sequence encoding the anti-Fzd antibody or antigen-binding fragment thereof, e.g., a Wnt surrogate, and the nucleic acid sequence encoding the Wnt polypeptide or Norrin polypeptide are present in the same vector, e.g., in the same expression cassette.

In related aspects, the present invention provides a method for increasing Wnt signaling in a tissue, comprising contacting the tissue with an effective amount of a cell comprising a nucleic acid sequence encoding an anti-Fzd antibody or antigen-binding fragment thereof, e.g., a Wnt surrogate, of the present invention. In certain embodiments, the tissue is also contacted with a cell comprising a nucleic acid sequence that encodes a Wnt polypeptide or Norrin polypeptide. In certain embodiments, the nucleic acid sequence encoding the anti-Fzd antibody or antigen-binding fragment thereof, e.g., a Wnt surrogate, and the nucleic acid sequence encoding the Wnt polypeptide or Norrin polypeptide are present in the same cell. In particular embodiments, the cell is a heterologous cell or an autologous cell obtained from the subject to be treated. In certain embodiments, the cell was transduced with a vector comprising an expression cassette encoding the anti-Fzd antibody or antigen-binding fragment thereof, e.g., a Wnt surrogate, or the Wnt polypeptide or Norrin polypeptide. In particular embodiments, the cell is a stem cell, e.g., an adipose-derived stem cell or a hematopoietic stem cell.

Anti-Fzd antibodies and antigen-binding fragments thereof, e.g., Wnt surrogates, may be used in to treat a disease, disorder or condition, for example, by increasing Wnt signaling in a targeted cell, tissue or organ. Thus, in some aspects, the present invention provides a method for treating a disease or condition in a subject in need thereof, e.g., a disease or disorder associated with reduced Wnt signaling, or for which increased Wnt signaling would provide a therapeutic benefit, comprising contacting the subject with an effective amount of a composition of the present disclosure. In particular embodiments, the composition is a pharmaceutical composition comprising any of: an anti-Fzd antibody or antigen-binding fragment thereof, e.g., a Wnt surrogate; a polynucleotide comprising a nucleic acid sequence encoding an anti-Fzd antibody or antigen-binding fragment thereof, e.g., a Wnt surrogate, e.g., a DNA or mRNA, optionally a modified mRNA; a vector comprising a nucleic acid sequence encoding an anti-Fzd antibody or antigen-binding fragment thereof, e.g., a Wnt surrogate, e.g., an expression vector or viral vector; or a cell comprising a nucleic acid sequence encoding an anti-Fzd antibody or antigen-binding fragment thereof, e.g., a Wnt surrogate, e.g., a cell transduced with an expression vector or viral vector encoding an anti-Fzd antibody or antigen-binding fragment thereof, e.g., a Wnt surrogate. In particular embodiments, the disease or condition is a pathological disease or disorder, or an injury, e.g., an injury resulting from a wound. In certain embodiments, the wound may be the result of another therapeutic treatment. In certain embodiments, the disease or condition comprises impaired tissue repair, healing or regeneration, or would benefit from increased tissue repair, healing or regeneration. In some embodiments, contacting occurs in vivo, i.e., the subject composition is administered to a subject.

In certain embodiments, the method comprises further contacting the subject with a pharmaceutical composition comprising one or more Whit polypeptides or Norrin polypeptides. The present disclosure contemplates contacting a subject with a first molecule for delivery of an anti-Fzd antibody or antigen-binding fragment thereof, e.g., a Wnt surrogate, as a first active agent and a second molecule for delivery of a Wnt polypeptide or Norrin polypeptide. The first and second molecule may be the same type of molecule or different types of molecules. For example, in certain embodiments, the first and second molecule may each be independently selected from the following types of molecules: polypeptides, small organic molecules, nucleic acids encoding the first or second active agent (optionally DNA or mRNA, optionally modified RNA), vectors comprising a nucleic acid sequence encoding the first or second active agent (optionally expression vectors or viral vectors), and cells comprising a nucleic acid sequence encoding the first or second active agent (optionally an expression cassette).

In related aspects, the present invention provides a method for treating a disease or condition, e.g., a disease or disorder associated with reduced Whit signaling, or for which increased Whit signaling would provide a therapeutic benefit, comprising contacting a subject in need thereof with a pharmaceutical composition comprising an effective amount of a polynucleotide comprising a nucleic acid sequence encoding an anti-Fzd antibody or antigen-binding fragment thereof, e.g., a Whit surrogate, disclosed herein. In certain embodiments, the subject is also contacted with a pharmaceutical composition comprising an effective amount of a polynucleotide comprising a nucleic acid sequence that encodes a Whit polypeptide or a Norrin polypeptide. In certain embodiments, the polynucleotides are DNA or mRNA, e.g., a modified mRNA. In particular embodiments, the polynucleotides are modified mRNAs further comprising a 5' cap sequence and/or a 3' tailing sequence, e.g., a polyA tail. In other embodiments, the polynucleotides are expression cassettes comprising a promoter operatively linked to the coding sequences. In certain embodiments, the nucleic acid sequence encoding the anti-Fzd antibody or antigen-binding fragment thereof, e.g., a Whit surrogate, and the nucleic acid sequence encoding the Whit polypeptide or Norrin polypeptide are present in the same polynucleotide.

In related aspects, the present invention provides a method for treating a disease or condition, e.g., a disease or disorder associated with reduced Wnt signaling, or for which increased Wnt signaling would provide a therapeutic benefit, comprising contacting a subject in need thereof with a pharmaceutical composition comprising an effective amount of a vector comprising a nucleic acid sequence encoding an anti-Fzd antibody or antigen-binding fragment thereof, e.g., a Wnt surrogate. In certain embodiments, the subject is also contacted with a pharmaceutical composition comprising an effective amount of a vector comprising a nucleic acid sequence that encodes a Wnt polypeptide or a Norrin polypeptide. In certain embodiments, the vector is an expression vector, and may comprise a promoter operatively linked to the nucleic acid sequence. In particular embodiments, the vector is a viral vector. In certain embodiments, the nucleic acid sequence encoding the anti-Fzd antibody or antigen-binding fragment thereof, e.g., a Wnt surrogate, and the nucleic acid sequence encoding the Wnt polypeptide or Norrin polypeptide are present in the same vector, e.g., in the same expression cassette.

In related aspects, the present invention provides a method for treating a disease or condition, e.g., a disease or disorder associated with reduced Wnt signaling, or for which increased Wnt signaling would provide a therapeutic benefit, comprising contacting a subject in need thereof with a pharmaceutical composition comprising an effective amount of a cell comprising a nucleic acid sequence encoding an anti-Fzd antibody or antigen-binding fragment thereof, e.g., a Wnt surrogate. In certain embodiments, the subject is also contacted with a cell comprising a nucleic acid sequence that encodes a Wnt polypeptide or a Norrin polypeptide. In certain embodiments, the nucleic acid sequence encoding the anti-Fzd antibody or antigen-binding fragment thereof, e.g., a Wnt surrogate, and the nucleic acid sequence encoding the Wnt polypeptide or Norrin polypeptide are present in the same cell. In particular embodiments, the cell is a heterologous cell or an autologous cell obtained from the subject to be treated. In certain embodiments, the cell was transduced with a vector comprising an expression cassette encoding the anti-Fzd antibody or antigen-binding fragment thereof, e.g., a Wnt surrogate, or the Wnt polypeptide or Norrin polypeptide. In particular embodiments, the cell is a stem cell, e.g., an adipose-derived stem cell or a hematopoietic stem cell.

Wnt signaling plays key roles in the developmental process and maintenance of stem cells. Reactivation of Wnt signals is associated with regeneration and repair of most tissues after injuries and diseases. Anti-Fzd antibody or antigen-binding fragment thereof, e.g., a Wnt surrogate, molecules are expected to provide benefit of healing and tissue repair in response to injuries and diseases. Causes of tissue damage and loss include but are not limited to aging, degeneration, hereditary conditions, infection and inflammation, traumatic injuries, toxins/metabolic-induced toxicities, or other pathological conditions. Wnt signals and enhancers of Wnt signals have been shown to activate adult, tissue-resident stem cells. In some embodiments, the compounds of the invention are administered for use in treating diseased or damaged tissue, for use in tissue regeneration and for use in cell growth and proliferation, and/or for use in tissue engineering.

Human diseases associated with mutations of the Wnt pathway provide strong evidence for enhancement of Wnt signals in the treatment and prevention of diseases. Preclinical in vivo and in vitro studies provide additional evidence of involvement of Wnt signals in many disease conditions and further support utilization of an anti-Fzd antibody or antigen-binding fragment thereof, e.g., a Wnt surrogate, in various human diseases.

Human diseases associated with mutations of the Wnt pathway provide strong evidence for enhancement of Wnt signals in the treatment and prevention of diseases. Preclinical in vivo and in vitro studies provide additional evidence of involvement of Wnt signals in many disease conditions and further support utilization of a Wnt surrogate molecule in various human diseases. For example, compositions of the present invention may be used to promote or increase bone growth or regeneration, bone grafting, healing of bone fractures, treatment of osteoporosis and osteoporotic fractures, spinal fusion, spinal cord injuries, including vertebral compression fractures, pre-operative spinal surgery optimization, osseointegration of orthopedic devices, tendon-bone integration, tooth growth and regeneration, dental implantation, periodontal diseases, maxillofacial reconstruction, and osteonecrosis of the jaw. They may also be used in the treatment of alopecia; enhancing regeneration of sensory organs, e.g. treatment of hearing loss, including regeneration of inner and outer auditory hair cells treatment of vestibular hypofunction, treatment of macular degeneration, treatment of retinopathies, including vitreoretinopathy, diabetic retinopathy, other diseases of retinal degeneration, Fuchs' dystrophy, other cornea disease, etc.; treatment of stroke, traumatic brain injury, Alzheimer's disease, multiple sclerosis, muscular dystrophy, muscle atrophy as a result of sarcopenia or cachexia, and other conditions affecting the degeneration or integrity of the blood brain barrier. The compositions of this invention may also be used in treatment of oral mucositis, treatment of short bowel syndrome, inflammatory bowel diseases (IBD), including Crohn's disease (CD) and ulcerative colitis (UC), in particular CD with fistula formation, other gastrointestinal disorders; treatment of metabolic syndrome, dyslipidemia, treatment of diabetes, treatment of pancreatitis, conditions where exocrine or endocrine pancreas tissues are damaged; conditions where enhanced epidermal regeneration is desired, e.g., epidermal wound healing, treatment of diabetic foot ulcers, syndromes involving tooth, nail, or dermal hypoplasia, etc., conditions where angiogenesis is beneficial; treatment of myocardial infarction, coronary artery disease, heart failure; enhanced growth of hematopoietic cells, e.g. enhancement of hematopoietic stem cell transplants from bone marrow, mobilized peripheral blood, treatment of immunodeficiencies, graft versus host diseases, etc.; treatment of acute kidney injuries, chronic kidney diseases; treatment of lung diseases, chronic obstructive pulmonary diseases (COPD), pulmonary fibrosis, including idiopathic pulmonary fibrosis, enhanced regeneration of lung tissues. The compositions of the present invention may also be used in enhanced regeneration of liver cells, e.g. liver regeneration, treatment of cirrhosis, enhancement of liver transplantations, treatment of acute liver failure, treatment of chronic liver diseases with hepatitis C or B virus infection or post-antiviral drug therapies, alcoholic liver diseases, alcoholic hepatitis, non-alcoholic liver diseases with steatosis or steatohepatitis, and the like. The compositions of this invention may treat diseases and disorders including, without limitation, conditions in which regenerative cell growth is desired.

Human genetics involving loss-of-function or gain-of-function mutations in Wnt signaling components show strong evidence supporting enhancing Wnt signals for bone growth. Conditions in which enhanced bone growth is desired may include, without limitation, fractures, grafts, ingrowth around prosthetic devices, osteoporosis, osteoporotic fractures, spinal fusion, vertebral compression fractures, pre-operative optimization for spinal surgeries, osteonecrosis of the jaw, dental implantation, periodontal diseases, maxillofacial reconstruction, and the like. An anti-Fzd antibody or antigen-binding fragment thereof, e.g., a Wnt surrogate, enhances and promotes Wnt signals which are critical in promoting bone regeneration. Methods for regeneration of bone tissues benefit from administration of the compounds of the invention, which can be systemic or localized. In some embodiments, bone marrow cells are exposed to molecules of the invention, such that stem cells within that marrow become activated.

In some embodiments, bone regeneration is enhanced by contacting a responsive cell population, e.g. bone marrow, bone progenitor cells, bone stem cells, etc. with an effective dose of an anti-Fzd antibody or antigen-binding fragment thereof, e.g., a Wnt surrogate, disclosed herein. Methods for regeneration of bone tissues benefit from administration of the anti-Fzd antibody or antigen-binding fragment thereof, e.g., a Wnt surrogate disclosed herein, which can be systemic or localized. In some such embodiments, the contacting is performed in vivo. In other such embodiments, the contacting is performed ex vivo. The molecule may be localized to the site of action, e.g. by loading onto a matrix, which is optionally biodegradable, and optionally provides for a sustained release of the active agent. Matrix carriers include, without limitation, absorbable collagen sponges, ceramics, hydrogels, polymeric microspheres, nanoparticles, bone cements, and the like.

Compositions comprising one or more anti-Fzd antibody or antigen-binding fragment thereof, e.g., a Wnt surrogate, disclosed herein can be used for the in vivo treatment of skeletal tissue deficiencies. By "skeletal tissue deficiency", it is meant a deficiency in bone or other skeletal connective tissue at any site where it is desired to restore the bone or connective tissue, no matter how the deficiency originated, e.g. whether as a result of surgical intervention, removal of tumor, ulceration, implant, fracture, or other traumatic or degenerative conditions. The compositions of the present invention can be used as part of a regimen for restoring cartilage function to a connective tissue, for the repair of defects or lesions in cartilage tissue such as degenerative wear and arthritis, trauma to the tissue, displacement of torn meniscus, meniscectomy, a luxation of a joint by a torn ligament, malalignment of joints, bone fracture, or by hereditary disease.

An anti-Fzd antibody or antigen-binding fragment thereof, e.g., a Wnt surrogate, may also be used for treatment of periodontal diseases. Periodontal diseases are a leading cause of tooth loss and are linked to multiple systemic conditions. In some embodiments, tooth or underlying bone regeneration is enhanced by contacting a responsive cell population. In some such embodiments, the contacting is performed in vivo. In other such embodiments, the contacting is performed ex vivo, with subsequent implantation of the activated stem or progenitor cells. The molecule may be localized to the site of action, e.g. by loading onto a matrix, which is optionally biodegradable, and optionally provides for a sustained release of the active agent. Matrix carriers include, without limitation, absorbable collagen sponges, ceramics, hydrogels, bone cements, polymeric microspheres, nanoparticles, and the like.

Studies have shown that biology of Wnt signaling and R-spondins are capable of promoting sensory hair cell regeneration in the inner ear following injuries, aging, or degeneration. Loss of sensory hair cells in the inner ear involved in hearing loss or vestibular hypofunction may also benefit from the compositions of the invention. In the inner ear, the auditory organ houses mechanosensitive hair cells required for translating sound vibration to electric impulses. The vestibular organs, comprised of the semicircular canals (SSCs), the utricle, and the saccule, also contain sensory hair cells in order to detect head position and motion. Compositions of the present invention can be used, for example, in an infusion; in a matrix or other depot system; or other topical application to the ear for enhancement of auditory regeneration.

An anti-Fzd antibody or antigen-binding fragment thereof, e.g., a Wnt surrogate, may also be used in regeneration of retinal tissue. In the adult mammalian retina, Muller glia cells are capable of regenerating retinal cells, including photoreceptors, for example after neurotoxic injury in vivo. Wnt signaling and enhancers of Wnt signals can promote proliferation of Muller glia-derived retinal progenitors after damage or during degeneration. The compositions of the invention may also be used in the regeneration of tissues and other cell types in the eye. For examples age-related macular degeneration (AMD), other retina degenerative diseases, cornea diseases, Fuchs' dystrophy, vitreoretinopathy, hereditary diseases, etc. can benefit from the compositions of the present inventions. AMD is characterized by progressively decreased central vision and visual acuity. Fuchs' dystrophy is characterized by progressive loss of cornea endothelial cells. Wnt signal and enhancing of Wnt signal can promote regeneration of cornea endothelium, retina epithelium, etc. in the eye tissue. In other embodiments, compositions of the present invention can be used, for example, in an infusion; in a matrix or other depot system; or other topical application to the eye for retinal regeneration and treatment of macular degeneration.

Specific populations of proliferating cells for homeostatic renewal of hepatocytes have been identified through lineage tracing studies, for example Axin2-positive cells in pericentral region. Lineage tracing studies also identified additional potential liver progenitor cells, including but not limited to Lgr-positive cells. The self-renewing liver cells and other populations of potential progenitor cells, including Lgr5-positive and Axin2-positive cells, are identified to be capable of regeneration responding to Wnt signals and/or R-spondins following injuries. Numerous preclinical models of acute liver injury and failure and chronic liver diseases showed recovery and regeneration of hepatocytes benefit from enhancing Wnt signals. The compositions of this invention may be used in treatment of acute liver failure, acute alcoholic liver injuries, treatment of chronic liver diseases with hepatitis C or B virus infection or post-antiviral drug therapies, chronic alcoholic liver diseases, alcoholic hepatitis, non-alcoholic fatty liver diseases and non-alcoholic steatohepatitis (NASH), treatment of cirrhosis and severe chronic liver diseases of all causes, and enhanced regeneration of liver cells. Methods for regeneration of liver tissue benefit from administration of the compounds of the invention, which can be systemic or localized. These include, but are not limited to, methods of systemic administration and methods of localized administration e.g. by injection into the liver tissue, by injection into veins or blood vessels leading into the liver, by implantation of a sustained release formulation, and the like.

Wnt signals play an important role in regeneration of various epithelial tissues. Various epidermal conditions benefit from treatment with the compounds of the present invention. Mucositis occurs when there is a breakdown of the rapidly divided epithelial cells lining the gastro-intestinal tract, leaving the mucosal tissue open to ulceration and infection. The part of the epithelial lining that covers the mouth, called the oral mucosa, is one of the most sensitive parts of the body and is particularly vulnerable to chemotherapy and radiation. Oral mucositis is probably the most common, debilitating complication of cancer treatments, particularly chemotherapy and radiation. In addition, the compositions of the invention may also benefit treatment of short bowel syndrome, inflammatory bowel diseases (IBD), or other gastrointestinal disorders. Other epidermal conditions include epidermal wound healing, diabetic foot ulcers, syndromes involving tooth, nail, or dermal hypoplasia, and the like. Molecules of the present invention may be used in all these conditions, where regenerative cells are contacted with compounds of the invention. Methods for regeneration of epithelial tissues benefit from administration of the compounds of the invention, which can be systemic or localized. Contacting can be, for example, topical, including intradermal, subdermal, in a gel, lotion, cream etc. applied at targeted site, etc.

In addition to skin and gastrointestinal tract, Wnt signals and enhancement and promotion of Wnt signals also play an important role in repair and regeneration of tissues including pancreas, kidney, and lung in preclinical models. An anti-Fzd antibody or antigen-binding fragment thereof, e.g., a Wnt surrogate, may benefit various disease conditions involving exocrine and endocrine pancreas, kidney, or lung. The anti-Fzd antibody or antigen-binding fragment thereof, e.g., a Wnt surrogate, may be used in treatment of metabolic syndrome; treatment of diabetes, treatment of acute or chronic pancreatitis, exocrine pancreatic insufficiency, treatment of acute kidney injuries, chronic kidney diseases, treatment of lung diseases, including but not limited to chronic obstructive pulmonary diseases (COPD), other conditions that cause loss of lung epithelial tissues. Methods for regeneration of these tissues benefit from administration of the compounds of the invention, which can be systemic or localized.

Epidermal Wnt signaling, in coordination with signaling via other development factors, is critical for adult hair follicle regeneration. Hair loss is a common problem, and androgenetic alopecia, often called male pattern baldness, is the most common form of hair loss in men. In some embodiments, hair follicle regeneration is enhanced by contacting a responsive cell population with a molecule of the present invention. In some such embodiments, the contacting is performed in vivo. In other such embodiments, the contacting is performed ex vivo. The molecule may be localized to the site of action, e.g. topical lotions, gels, creams and the like.

Stroke, traumatic brain injury, Alzheimer's disease, multiple sclerosis and other conditions affecting the blood brain barrier (BBB) may be treated with an anti-Fzd antibody or antigen-binding fragment thereof, e.g., a Wnt surrogate. Angiogenesis is critical to ensure the supply of oxygen and nutrients to many tissues throughout the body, and is especially important for the CNS as the neural tissue is extremely sensitive to hypoxia and ischemia. CNS endothelial cells which form the BBB differ from endothelial cells in non-neural tissue, in that they are highly polarized cells held together by tight junctions and express specific transporters. Wnt signaling regulates CNS vessel formation and/or function. Conditions in which the BBB is compromised can benefit from administration of the compounds of the invention, which can be systemic or localized e.g. by direct injection, intrathecal administration, implantation of sustained release formulations, and the like. In addition, Wnt signal is actively involved in neurogenesis and plays a role of neuroprotection following injury. The compositions of the present invention may also be used in treatment of spinal cord injuries, other spinal cord diseases, stroke, traumatic brain injuries, etc.

Wnt signals also play a role in angiogenesis. An anti-Fzd antibody or antigen-binding fragment thereof, e.g., a Wnt surrogate, may benefit conditions where angiogenesis is beneficial, treatment of myocardial infarction, coronary artery disease, heart failure, diabetic retinopathy, etc., and conditions from hereditary diseases. Methods for regeneration of these tissues benefit from administration of the compounds of the invention, which can be systemic or localized.

In certain embodiments, methods of the present invention promote tissue regeneration, e.g., in a tissue subjected to damage or tissue or cell reduction or loss. The loss or damage can be anything which causes the cell number to diminish, including diseases or injuries. For example, an accident, an autoimmune disorder, a therapeutic side-effect or a disease state could constitute trauma. Tissue regeneration increases the cell number within the tissue and preferably enables connections between cells of the tissue to be re-established, and more preferably the functionality of the tissue to be regained.

Reducing Wnt Pathway Signaling and Related Therapeutic Methods

In certain embodiments, an anti-Fzd antibody or antigen-binding fragment thereof, may be used to decrease or inhibit Wnt signaling in a tissue or cell. Thus, in some aspects, the present invention provides a method for decreasing Wnt signaling or inhibiting Wnt signaling in a tissue or cell, comprising contacting the tissue or cell with an effective amount of an anti-Fzd antibody, or antigen-binding fragment thereof, disclosed herein, wherein the anti-Fzd antibody or antigen-binding fragment thereof is a Wnt signaling pathway antagonist or inhibitor. In some embodiments, contacting occurs in vitro, ex vivo, or in vivo. In particular embodiments, the cell is a cultured cell, and the contacting occurs in vitro.

In related aspects, the present invention provides a method for decreasing or inhibiting Wnt signaling in a tissue or cell, comprising contacting the tissue or cell with an effective amount of a polynucleotide comprising an anti-Fzd antibody or antigen-binding fragment thereof, of the present invention, wherein the anti-Fzd antibody or antigen-binding fragment thereof is a Wnt signaling pathway antagonist or inhibitor. In certain embodiments, the polynucleotides are DNA or mRNA, e.g., a modified mRNA. In particular embodiments, the polynucleotides are modified mRNAs further comprising a 5' cap sequence and/or a 3' tailing sequence, e.g., a polyA tail. In other embodiments, the polynucleotides are expression cassettes comprising a promoter operatively linked to the coding sequences In related aspects, the present invention provides a method for decreasing or inhibiting Wnt signaling in a tissue or cell, comprising contacting the tissue or cell with an effective amount of a vector comprising a nucleic acid sequence encoding an anti-Fzd antibody or antigen-binding fragment thereof, wherein the anti-Fzd antibody or antigen-binding fragment thereof is a Wnt signaling pathway antagonist or inhibitor. In certain embodiments, the vector is an expression vector, and may comprise a promoter operatively linked to the nucleic acid sequence. In particular embodiments, the vector is a viral vector.

In related aspects, the present invention provides a method for decreasing or inhibiting Wnt signaling in a tissue, comprising contacting the tissue with an effective amount of a cell comprising a nucleic acid sequence encoding an anti-Fzd antibody or antigen-binding fragment thereof, wherein the anti-Fzd antibody or antigen-binding fragment thereof is a Wnt signaling pathway antagonist or inhibitor. In particular embodiments, the cell is a heterologous cell or an autologous cell obtained from the subject to be treated. In certain embodiments, the cell was transduced with a vector comprising an expression cassette encoding the anti-Fzd antibody or antigen-binding fragment thereof, wherein the anti-Fzd antibody or antigen-binding fragment thereof is a Wnt signaling pathway antagonist or inhibitor. In particular embodiments, the cell is a stem cell, e.g., an adipose-derived stem cell or a hematopoietic stem cell.

Anti-Fzd antibodies and antigen-binding fragments thereof, wherein the anti-Fzd antibody or antigen-binding fragment thereof is a Wnt signaling pathway antagonist or inhibitor, may be used in to treat a disease, disorder or condition, for example, by decreasing or inhibiting Wnt signaling in a cell, tissue or organ. Thus, in some aspects, the present invention provides a method for treating a disease or condition in a subject in need thereof, e.g., a disease or disorder associated with increased or deregulated Wnt signaling, or for which decreased Wnt signaling would provide a therapeutic benefit, comprising contacting the subject with an effective amount of a composition comprising an anti-Fzd antibody or antigen-binding fragment thereof, wherein the anti-Fzd antibody or antigen-binding fragment thereof is a Wnt signaling pathway antagonist or inhibitor. In particular embodiments, the composition is a pharmaceutical composition comprising any of: an anti-Fzd antibody or antigen-binding fragment thereof; a polynucleotide comprising a nucleic acid sequence encoding an anti-Fzd antibody or antigen-binding fragment thereof, e.g., a DNA or mRNA, optionally a modified mRNA; a vector comprising a nucleic acid sequence encoding an anti-Fzd antibody or antigen-binding fragment thereof, e.g., an expression vector or viral vector; or a cell comprising a nucleic acid sequence encoding an anti-Fzd antibody or antigen-binding fragment thereof, e.g., a cell transduced with an expression vector or viral vector encoding an anti-Fzd antibody or antigen-binding fragment thereof. In particular embodiments, the disease or condition is a pathological disease or disorder, or an injury. In some embodiments, contacting occurs in vivo, i.e., the subject composition is administered to a subject.

In related aspects, the present invention provides a method for treating a disease or condition, e.g., a disease or disorder associated with increased Wnt signaling, or for which reduced Wnt signaling would provide a therapeutic benefit, comprising contacting a subject in need thereof with a pharmaceutical composition comprising an effective amount of a polynucleotide comprising a nucleic acid sequence encoding an anti-Fzd antibody or antigen-binding fragment thereof, wherein the antibody or antigen-binding fragment thereof is a Wnt signaling pathway antagonist or inhibitor, disclosed herein. In certain embodiments, the polynucleotides are DNA or mRNA, e.g., a modified mRNA. In particular embodiments, the polynucleotides are modified mRNAs further comprising a 5' cap sequence and/or a 3' tailing sequence, e.g., a polyA tail. In other embodiments, the polynucleotides are expression cassettes comprising a promoter operatively linked to the coding sequences In related aspects, the present invention provides a method for treating a disease or condition, e.g., a disease or disorder associated with increased Wnt signaling, or for which decreased Wnt signaling would provide a therapeutic benefit, comprising contacting a subject in need thereof with a pharmaceutical composition comprising an effective amount of a vector comprising a nucleic acid sequence encoding an anti-Fzd antibody or antigen-binding fragment thereof, wherein the antibody or antigen-binding fragment thereof is a Wnt signaling pathway antagonist or inhibitor. In certain embodiments, the vector is an expression vector, and may comprise a promoter operatively linked to the nucleic acid sequence. In particular embodiments, the vector is a viral vector.

In related aspects, the present invention provides a method for treating a disease or condition, e.g., a disease or disorder associated with increased Wnt signaling, or for which decreased Wnt signaling would provide a therapeutic benefit, comprising contacting a subject in need thereof with a pharmaceutical composition comprising an effective amount of a cell comprising a nucleic acid sequence encoding an anti-Fzd antibody or antigen-binding fragment thereof, wherein the antibody or antigen-binding fragment thereof is a Wnt signaling pathway antagonist or inhibitor. In particular embodiments, the cell is a heterologous cell or an autologous cell obtained from the subject to be treated. In certain embodiments, the cell was transduced with a vector comprising an expression cassette encoding the anti-Fzd antibody or antigen-binding fragment thereof. In particular embodiments, the cell is a stem cell, e.g., an adipose-derived stem cell or a hematopoietic stem cell.

In certain embodiments, methods of treating or preventing diseases or disorders in a subject in need thereof, by providing to the subject an effective amount of an anti-Fzd antibody, or an antigen-binding fragment thereof, wherein the antibody or the antigen-binding fragment thereof is an inhibitor of a Wnt signaling pathway, may be used to treat a cancer or tumor, e.g., a solid or liquid tumor. Examples of cancers and tumors that may be treated include, but are not limited to: colon tumors (e.g. colon cancer or adenoma), stomach tumors (e.g., stomach cancer), small intestine tumors (e.g., small intestinal cancer), liver tumors (e.g., liver cancer), pancreas tumors (e.g., pancreatic cancer), lung tumors (e.g., lung cancer), ovary tumors (e.g., ovarian cancer), kidney (e.g., kidney cancer), brain tumors (e.g., brain cancer), spinal cord tumors (e.g., spinal cord cancer), skin tumors (e.g., skin cancer or melanoma), head and neck tumors (e.g., head and neck cancer), gastointestinal tract tumors (e.g., gastrointestinal cancer, esophageal cancer, oral mucosa cancer, tongue cancer, stomach cancer, intestinal cancer, colon cancer), breast tumors (e.g., breast cancer), prostate tumors (e.g., prostate cancer), bone tumors (e.g., bone cancer), vascular tumors, Wilms tumor, leukemina/ lymphoma, soft tissue tumors (e.g., soft tissue sarcoma or synovial sarcoma) and metastatic cancers, etc.

In certain embodiments, methods of treating or preventing diseases or disorders in a subject in need thereof, by providing to the subject an effective amount of an anti-Fzd antibody, or an antigen-binding fragment thereof, wherein the antibody or the antigen-binding fragment thereof is an inhibitor of a Wnt signaling pathway, may be used to treat degenerative diseases. Examples of degenerative diseases that may be treated include, but are not limited to osteoarthritis, cartilage degeneration, sports injuries (e.g., cartilage injury), retinopathy, atherosclerosis, neurodegenerative disorders, and vascular disorders e.g. vasculitis, conditions with abnormal angiogenesis.

In certain embodiments, methods of treating or preventing diseases or disorders in a subject in need thereof, by providing to the subject an effective amount of an anti-Fzd antibody, or an antigen-binding fragment thereof, wherein the antibody or the antigen-binding fragment thereof is an inhibitor of a Wnt signaling pathway, may be used to treat fibrosis. Examples of fibrosis that may be treated include, but are not limited to, lung fibrosis (including but not limited to COPD and idiopathic pulmonary fibrosis), kidney fibrosis (e.g. end stage renal failure), liver fibrosis, congenital liver storage diseases, and cardiac fibrosis.

In certain embodiments, methods of treating or preventing diseases or disorders in a subject in need thereof, by providing to the subject an effective amount of an anti-Fzd antibody, or an antigen-binding fragment thereof, wherein the antibody or the antigen-binding fragment thereof is an inhibitor of a Wnt signaling pathway, may be used to treat heart failure, e.g., congestive heart failure, systolic heart failure, heart failure with preserved ejection fraction, or coronary artery disease.

In certain embodiments, methods of treating or preventing diseases or disorders in a subject in need thereof, by providing to the subject an effective amount of an anti-Fzd antibody, or an antigen-binding fragment thereof, wherein the antibody or the antigen-binding fragment thereof is an inhibitor of a Wnt signaling pathway, may be used to treat heterotopic ossification, osteopetrosis, or congenital high bone mass disorders.

The terms "administering" or "introducing" or "providing", as used herein, refer to delivery of a composition to a cell, to cells, tissues and/or organs of a subject, or to a subject. Such administering or introducing may take place in vivo, in vitro or ex vivo.

In particular embodiments, a pharmaceutical composition is administered parenterally, e.g., intravenously, orally, rectally, or by injection. In some embodiments, it is administered locally, e.g., topically or intramuscularly. In some embodiments, a composition is administered to target tissues, e.g., to bone, joints, ear tissue, eye tissue, gastrointestinal tract, skin, a wound site or spinal cord. Methods of the invention may be practiced in vivo or ex vivo. In some embodiments, the contacting of a target cell or tissue with a tissue-specific Wnt signal enhancing molecule is performed ex vivo, with subsequent implantation of the cells or tissues, e.g., activated stem or progenitor cells, into the subject. The skilled artisan can determine an appropriate site of and route of administration based on the disease or disorder being treated.

The dose and dosage regimen may depend upon a variety of factors readily determined by a physician, such as the nature of the disease or disorder, the characteristics of the subject, and the subject's history. In particular embodiments, the amount of anti-Fzd antibody or antigen-binding fragment thereof, e.g., a Wnt surrogate, administered or provided to the subject is in the range of about 0.01 mg/kg to about 50 mg/kg, 0.1 mg/kg to about 500 mg/kg, or about 0.1 mg/kg to about 50 mg/kg of the subject's body weight.

The terms "treatment", "treating" and the like are used herein to generally mean obtaining a desired pharmacologic and/or physiologic effect. The effect may be prophylactic in terms of completely or partially preventing a disease or symptom thereof, e.g. reducing the likelihood that the disease or symptom thereof occurs in the subject, and/or may be therapeutic in terms of a partial or complete cure for a disease and/or adverse effect attributable to the disease. "Treatment" as used herein covers any treatment of a disease in a mammal, and includes: (a) preventing the disease from occurring in a subject which may be predisposed to the disease but has not yet been diagnosed as having it; (b) inhibiting the disease, i.e., arresting its development; or (c) relieving the disease, i.e., causing regression of the disease. The therapeutic agent (e.g., anti-Fzd antibody or antigen-binding fragment thereof) may be administered before, during or after the onset of disease or injury. The treatment of ongoing disease, where the treatment stabilizes or reduces the undesirable clinical symptoms of the patient, is of particular interest. Such treatment is desirably performed prior to complete loss of function in the affected tissues. The subject therapy will desirably be administered during the symptomatic stage of the disease, and in some cases after the symptomatic stage of the disease. In some embodiments, the subject method results in a therapeutic benefit, e.g., preventing the development of a disorder, halting the progression of a disorder, reversing the progression of a disorder, etc. In some embodiments, the subject method comprises the step of detecting that a therapeutic benefit has been achieved. The ordinarily skilled artisan will appreciate that such measures of therapeutic efficacy will be applicable to the particular disease being modified, and will recognize the appropriate detection methods to use to measure therapeutic efficacy.

Promoting Cell, Tissue and Organoid Growth and Related Methods

Other embodiments relate, in part, to the use of the Wnt surrogate molecules disclosed herein to promote or enhance the growth or proliferation of cells, tissues and organoids, for example, by contacting cells or tissue with one or more Wnt surrogate, optionally in combination with a Norrin or Rspondin polypeptide. In certain embodiments, the cells or tissue are contacted ex vivo, in vitro, or in vivo. Such methods may be used to generate cells, tissue or organoids for therapeutic use, e.g., to be transplanted or grafted into a subject. They may also be used to generate cells, tissue or organoids for research use. The Wnt surrogate molecules have widespread applications in non-therapeutic methods, for example in vitro research methods.

The invention provides a method for tissue regeneration of damaged tissue, such as the tissues discussed above, comprising administering a Wnt surrogate molecule to cells. The Wnt surrogate molecule may be administered directly to the cells in vivo, administered to a subject orally, intravenously, or by other methods known in the art, or administered to ex vivo cells. In some embodiments where the Wnt surrogate molecule is administered to ex vivo cells, these cells may be transplanted into a subject before, after or during administration of the Wnt surrogate molecule.

Wnt signaling is a key component of stem cell culture. For example, the stem cell culture media as described in WO2010/090513, WO2012/014076, Sato et al., 2011 (GASTROENTEROLOGY 201 1; 141: 1762-1772) and Sato et al., 2009 (Nature 459, 262-5). The Wnt surrogate molecules disclosed herein are suitable alternatives to Rspondin for use in these stem cell culture media, or may be combined with Rspondin.

Accordingly, in one embodiment, the disclosure provides a method for enhancing the proliferation of stem cells comprising contacting stem cells with one or more Wnt surrogate molecules disclosed herein. In one embodiment, the disclosure provides a cell culture medium comprising one or more Wnt surrogate molecules disclosed herein. In some embodiments, the cell culture medium may be any cell culture medium already known in the art that normally comprises Wnt or Rspondin, but wherein the Wnt or Rspondin is replaced (wholly or partially) or supplemented by Wnt surrogate molecule(s) disclosed herein. For example, the culture medium may be as described in as described in WO2010/090513, WO2012/014076, Sato et al., 2011 (GASTROENTEROLOGY 201 1; 141: 1762-1772) and Sato et al., 2009 (Nature 459, 262-5), which are hereby incorporated by reference in their entirety.

Stem cell culture media often comprise additional growth factors. This method may thus additionally comprise supplying the stem cells with a growth factor. Growth factors commonly used in cell culture medium include epidermal growth factor (EGF, (Peprotech), Transforming Growth Factor-alpha (TGF-alpha, Peprotech), basic Fibroblast Growth Factor (bFGF, Peprotech), brain-derived neurotrophic factor (BDNF, R&D Systems), Hepatocyte Growth Factor (HGF) and Keratinocyte Growth Factor (KGF, Peprotech, also known as FGF7). EGF is a potent mitogenic factor for a variety of cultured ectodermal and mesodermal cells and has a profound effect on the differentiation of specific cells in vivo and in vitro and of some fibroblasts in cell culture. The EGF precursor exists as a membrane-bound molecule which is proteolytically cleaved to generate the 53-amino acid peptide hormone that stimulates cells. EGF or other mitogenic growth factors may thus be supplied to the stem cells. During culturing of stem cells, the mitogenic growth factor may be added to the culture medium every second day, while the culture medium is refreshed preferably every fourth day. In general, a mitogenic factor is selected from the groups consisting of: i) EGF, TGF-alpha, and KGF, ii) EGF, TGF-alpha, and FGF7; iii) EGF, TGF-alpha, and FGF; iv) EGF and KGF; v) EGF and FGF7; vi) EGF and a FGF; vii) TGF-alpha and KGF; viii) TGF-alpha, and FGF7; ix) or from TGF-alpha and a FGF. In certain embodiments, the disclosure includes a stem cell culture media comprising a Wnt surrogate molecule disclosed herein, e.g., optionally in combination with one or more of the growth factors or combinations thereof described herein.

These methods of enhancing proliferation of stem cells can be used to grow new organoids and tissues from stem cells, as for example described in WO2010/090513 WO2012/014076, Sato et al., 201 1 (GASTROENTEROLOGY 2011; 141: 1762-1772) and Sato et al., 2009 (Nature 459, 262-5).

In some embodiments, the Wnt surrogate molecules are used to enhance stem cell regeneration. Illustrative stem cells of interest include but are not limited to: muscle satellite cells; hematopoietic stem cells and progenitor cells derived therefrom (U.S. Pat. No. 5,061,620); neural stem cells (see Morrison et al. (1999) Cell 96: 737-749); embryonic stem cells; mesenchymal stem cells; mesodermal stem cells; liver stem cells; adipose-tissue derived stem cells, etc.

Diagnostic and Related Methods

Other embodiments of the present invention relate, in part, to diagnostic applications for detecting the presence of cells or tissues expressing aFzd receptor. Thus, the present disclosure provides methods of detecting a Fzd receptor in a sample, such as detection of cells or tissues expressing Fzd1. Such methods can be applied in a variety of known detection formats, including, but not limited to immunohistochemistry (IHC), immunocytochemistry (ICC), in situ hybridization (ISH), whole-mount in situ hybridization (WISH), fluorescent DNA in situ hybridization (FISH), flow cytometry, enzyme immuno-assay (EIA), and enzyme linked immuno-assay (ELISA). In particular embodiments, a method comprises contacting a tissue or cell, e.g., obtained from a subject, with an antibody or antigen-binding fragment thereof disclosed herein, and then determining an amount of binding of the antibody or antigen-binding fragment thereof to the tissue or cell, thus determining the presence of or an amount of the Fzd receptor(s) in the tissue or cell.

ISH is a type of hybridization that uses a labeled complementary DNA or RNA strand (i.e., primary binding agent) to localize a specific DNA or RNA sequence in a portion or section of a cell or tissue (in situ), or if the tissue is small enough, the entire tissue (whole mount ISH). One having ordinary skill in the art would appreciate that this is distinct from immunohistochemistry, which localizes proteins in tissue sections using an antibody as a primary binding agent. DNA ISH can be used on genomic DNA to determine the structure of chromosomes. Fluorescent DNA ISH (FISH) can, for example, be used in medical diagnostics to assess chromosomal integrity. RNA ISH (hybridization histochemistry) is used to measure and localize mRNAs and other transcripts within tissue sections or whole mounts.

In various embodiments, the antibodies and antigen-binding fragments thereof described herein are conjugated to a detectable label that may be detected directly or indirectly. In this regard, an antibody "conjugate" refers to an anti-Fzd antibody or antigen-binding fragment thereof that is covalently linked to a detectable label. In the present invention, DNA probes, RNA probes, monoclonal antibodies, antigen-binding fragments thereof, and antibody derivatives thereof, such as a single-chain-variable-fragment antibody or an epitope tagged antibody, may all be covalently linked to a detectable label. In "direct detection", only one detectable antibody is used, i.e., a primary detectable antibody. Thus, direct detection means that the antibody that is conjugated to a detectable label may be detected, per se, without the need for the addition of a second antibody (secondary antibody).

A "detectable label" is a molecule or material that can produce a detectable (such as visually, electronically or otherwise) signal that indicates the presence and/or concentration of the label in a sample. When conjugated to an antibody, the detectable label can be used to locate and/or quantify the target to which the specific antibody is directed. Thereby, the presence and/or concentration of the target in a sample can be detected by detecting the signal produced by the detectable label. A detectable label can be detected directly or indirectly, and several different detectable labels conjugated to different specific-antibodies can be used in combination to detect one or more targets.

Examples of detectable labels, which may be detected directly, include fluorescent dyes and radioactive substances and metal particles. In contrast, indirect detection requires the application of one or more additional antibodies, i.e., secondary antibodies, after application of the primary antibody. Thus, the detection is performed by the detection of the binding of the secondary antibody or binding agent to the primary detectable antibody. Examples of primary detectable binding agents or antibodies requiring addition of a secondary binding agent or antibody include enzymatic detectable binding agents and hapten detectable binding agents or antibodies.

In some embodiments, the detectable label is conjugated to a nucleic acid polymer which comprises the first binding agent (e.g., in an ISH, WISH, or FISH process). In other embodiments, the detectable label is conjugated to an antibody which comprises the first binding agent (e.g., in an IHC process).

Examples of detectable labels which may be conjugated to antibodies used in the methods of the present disclosure include fluorescent labels, enzyme labels, radioisotopes, chemiluminescent labels, electrochemiluminescent labels, bioluminescent labels, polymers, polymer particles, metal particles, haptens, and dyes.

Examples of fluorescent labels include 5-(and 6)-carboxyfluorescein, 5- or 6-carboxyfluorescein, 6-(fluorescein)-5-(and 6)-carboxamido hexanoic acid, fluorescein isothiocyanate, rhodamine, tetramethylrhodamine, and dyes such as Cy2, Cy3, and Cy5, optionally substituted coumarin including AMCA, PerCP, phycobiliproteins including R-phycoerythrin (RPE) and allophycoerythrin (APC), Texas Red, Princeton Red, green fluorescent protein (GFP) and analogues thereof, and conjugates of R-phycoerythrin or allophycoerythrin, inorganic fluorescent labels such as particles based on semiconductor material like coated CdSe nanocrystallites.

Examples of polymer particle labels include micro particles or latex particles of polystyrene, PMMA or silica, which can be embedded with fluorescent dyes, or polymer micelles or capsules which contain dyes, enzymes or substrates.

Examples of metal particle labels include gold particles and coated gold particles, which can be converted by silver stains. Examples of haptens include DNP, fluorescein isothiocyanate (FITC), biotin, and digoxigenin. Examples of enzymatic labels include horseradish peroxidase (HRP), alkaline phosphatase (ALP or AP), β-galactosidase (GAL), glucose-6-phosphate dehydrogenase, β-N-acetylglucosamimidase, β-glucuronidase, invertase, Xanthine Oxidase, firefly luciferase and glucose oxidase (GO). Examples of commonly used substrates for horseradishperoxidase include 3,3'-diaminobenzidine (DAB), diaminobenzidine with nickel enhancement, 3-amino-9-ethylcarbazole (AEC), Benzidine dihydrochloride (BDHC), Hanker-Yates reagent (HYR), Indophane blue (IB), tetramethylbenzidine (TMB), 4-chloro-1-naphtol (CN), .alpha.-naphtol pyronin (.alpha.-NP), o-dianisidine (OD), 5-bromo-4-chloro-3-indolylphosphate (BCIP), Nitro blue tetrazolium (NBT), 2-(p-iodophenyl)-3-p-nitropheny-I-5-phenyl tetrazolium chloride (INT), tetranitro blue tetrazolium (TNBT), 5-bromo-4-chloro-3-indoxyl-beta-D-galactosidelferro-ferricyanide (BCIG/FF).

Examples of commonly used substrates for Alkaline Phosphatase include Naphthol-AS-B 1-phosphate/fast red TR (NABP/FR), Naphthol-AS-MX-phosphate/fast red TR (NAMP/FR), Naphthol-AS-B1-phosphate/-fast red TR (NABP/FR), Naphthol-AS-MX-phosphatelfast red TR (NAMP/FR), Naphthol-AS-B1-phosphate/new fuschin (NABP/NF), bromochloroindolyl phosphate/nitroblue tetrazolium (BCIP/NBT), 5-Bromo-4-chloro-3-indolyl-b-d-galactopyranoside (BCIG).

Examples of luminescent labels include luminol, isoluminol, acridinium esters, 1,2-dioxetanes and pyridopyridazines. Examples of electrochemiluminescent labels include ruthenium derivatives. Examples of radioactive labels include radioactive isotopes of iodide, cobalt, selenium, tritium, carbon, sulfur and phosphorous.

Detectable labels may be linked to the antibodies described herein or to any other molecule that specifically binds to a biological marker of interest, e.g., an antibody, a nucleic acid probe, or a polymer. Furthermore, one of ordinary skill in the art would appreciate that detectable labels can also be conjugated to second, and/or third, and/or fourth, and/or fifth binding agents or antibodies, etc. Moreover, the skilled artisan would appreciate that each additional binding agent or antibody used to characterize a biological marker of interest may serve as a signal amplification step. The biological marker may be detected visually using, e.g., light microscopy, fluorescent microscopy, electron microscopy where the detectable substance is for example a dye, a colloidal gold particle, a luminescent reagent. Visually detectable substances bound to a biological marker may also be detected using a spectrophotometer. Where the detectable substance is a radioactive isotope detection can be visually by autoradiography, or non-visually using a scintillation counter. See, e.g., Larsson, 1988, Immunocytochemistry: Theory and Practice, (CRC Press, Boca Raton, Fla.); Methods in Molecular Biology, vol. 80 1998, John D. Pound (ed.) (Humana Press, Totowa, N.J.).

The invention further provides kits for detecting a Fzd receptor or cells or tissues expressing one or more Fzd receptors in a sample, wherein the kits contain at least one antibody, polypeptide, polynucleotide, vector or host cell as described herein. In certain embodiments, a kit may comprise buffers, enzymes, labels, substrates, beads or other surfaces to which the antibodies of the invention are attached, and the like, and instructions for use.

All of the above U.S. patents, U.S. patent application publications, U.S. patent applications, foreign patents, foreign patent applications and non-patent publications referred to in this specification and/or listed in the Application Data Sheet, are incorporated herein by reference, in their entirety.

From the foregoing it will be appreciated that, although specific embodiments of the invention have been described herein for purposes of illustration, various modifications may be made without deviating from the spirit and scope of the invention. Accordingly, the invention is not limited except as by the appended claims.

EXAMPLES

Example 1

Characterization of Anti-Fzd Antibodies

Antibody Fab, scFv and VHH or sdAb fragments disclosed herein were sequenced and sub-cloned into mammalian expression vectors for expression, purification, and characterization of binding affinities to various Fzd receptors.

Soluble recombinant proteins were prepared by transfection of respective expression vectors into Expi293F cells (Thermo Fisher Scientific, Waltham, Mass.) according to the manufacturer's instructions. Briefly, four days after the transfection, cell culture medium was collected after spin down the cell pellet. The media were incubated with either Protein A resin (REPLIGEN, Waltham, Mass.) for collecting proteins containing human IgG-Fc portion, or Nickel affinity resin (Roche, Basel, Switzerland) for collecting proteins conjugated with His-tag. Proteins were eluted with 10 mM glycine, pH 3.5 from Protein A resin, or with 150 mM imidazole, pH 7.4 from Nickel affinity resin, respectively.

Subsequently, the protein elutes were fractionated and further purified by size-exclusion chromatography (SEC). SEC was performed by a fast protein liquid chromatography using a Superdex 200 Increase 10/300 GL (GE Healthcare, Pittsburgh, Pa.) in HBS buffer (10 mM HEPES, 150 mM NaCl, pH7.4). Each protein was injected onto the column at a volume of 475 μl or 500 μl. The absorbance at 280 nm was monitored, and the 500 μl fractions of all elutes were collected. Each collected faction near main peak was further analyzed by SDS-Polyacrylamide Gel Electrophoresis (SDS-PAGE) to confirm the content. SDS-PAGE was performed using Tris-HCl 4-15% gel (Bio-Rad, Hercules, Calif.) under both non-reducing and reducing conditions. The samples were prepared in Laemmli sample buffer and heated at 100° C. for 5 min.

Protein concentrations were determined using a Nano-Drop Spectrophotometer (Thermo Scientific) by the direct UV A280 method. The relationship of absorbance to protein concentration is linear based on Beer-Lamber equation, $A=\varepsilon$ l c; A is the absorbance value, t is the wavelength-dependent extinction coefficient, l is the path length in centimeters, and c is the protein concentration. The experimental extinction coefficients of all produced proteins were estimated by their amino acid sequences.

Table 2 provides the heavy chain CDRs (CDRH1, CDRH2, and CDRH3) and light chain CDRs (CDRL1, CDRL2, and CDRL3) for the indicated antibody clones. The Abgenesis software from Distributed Bio was used to map the specificity determining regions (SDRs) shown below, which include the Kabat definition of CDRs (Padlan et al. *FASEB J.* 9, 133-139 (1995)).

Table 2 also indicates the Fzd receptor the antibody fragment was shown to bind. Confirmation of the binding of theFzd receptor to which each clone was raised was determined by detection of phage-displayed antibody fragments bound to target antigen immobilized on Nunc Maxisorb microtiter plates (Thermo Fisher Scientific, Waltham, Mass.) by single-dose or dose-dependent ELISA. Detection of bound phage was determined calorimetrically by turnover of TMB substrate (Thermo Fisher Scientific, Waltham, Mass.) at 415 nm by anti-M13-HRP antibody (GE Healthcare, Pittsburgh, Pa.). Clones were identified as binding to a Fzd receptor when the fold OD 450 nm over background was greater than a threshold level.

TABLE 2

Clone IDs and CDR sequences for hinge specific ("L") or hinge (L) + CRD ("ext") binders. "CDRH" indicates heavy chain CDRs, and "CDRL" indicates light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| (heavy chain CDRs) | | | | | | | | |
| 031S-A01 | hFzd1ext | YTFTSYYMH | 34 | GVIKPSGGSTSYA | 730 | CARGGGVFDYW | 1426 | hFzd1L, 2L, 7L |
| 032S-A01 | hFzd1L | DTLSSYGIS | 35 | GWINPNSGGTNYA | 731 | CARMGHWYFDLW | 1427 | hFzd1L, mFzd1L |
| 033S-A01 | hFzd1L | GTFSSSAIS | 36 | GIINPSGGGTSYA | 732 | CARRRPIVNWNDLDAFDIW | 1428 | hFzd1L, mFzd1L |
| 033S-B01 | hFzd1L | GTFSRYGIS | 37 | GIINPSGGGTSYA | 733 | CAREGEYCSSTSCAREEVW | 1429 | hFzd1L, mFzd1L |
| 033S-C01 | hFzd1L | GTFSTYAFN | 38 | GIINPSGGSTSYA | 734 | CARREYSGYDHDAFDIW | 1430 | hFzd1L, mFzd1L |
| 033S-E01 | hFzd1L | GTFTYDYMH | 39 | GIINPSGGSTSYA | 735 | CARGGYSSSWYPAAEYFQHW | 1431 | hFzd1L, mFzd1L |
| 033S-F01 | hFzd1L | YSRSYYMY | 40 | GGIIPIFGTANYA | 736 | CARRDIWVPAAKMEGAFDIW | 1432 | hFzd1L, mFzd1L |
| 033S-G01 | hFzd1L | GSFTNYAIS | 41 | GIIKPSGDSTSYA | 737 | CASRAIFGWENYYMDVW | 1433 | mFzd1L |
| 033S-H01 | hFzd1L | YTFTRYGMN | 42 | GIINPSGGSTSYA | 738 | CARVIYDGMDVW | 1434 | hFzd1L, mFzd1L |
| 033S-B02 | hFzd1L | DTFDTYAIS | 43 | GIINPSGGSTSYA | 739 | CARRAVAGIFDYW | 1435 | hFzd1L, mFzd1L |
| 033S-C02 | hFzd1L | GTFSNYAIS | 44 | GWMNPDSGHTGYA | 740 | CARRIVWTGDHAFDIW | 1436 | hFzd1L, mFzd1L |
| 033S-D02 | hFzd1L | ITFTSSAVH | 45 | GIINPSGGSTSYA | 741 | CARRMVYAPYKDVW | 1437 | hFzd1L, mFzd1L |
| 033S-E02 | hFzd1L | GTFTSYAIS | 46 | GMINPSGGRTTYA | 742 | CAIRTIFGWIDYW | 1438 | hFzd1L, mFzd1L |
| 033S-F02 | hFzd1L | GTFSNSIIN | 47 | GVINPSGGYTSYA | 743 | CARRIDSSGYSSRYFDLW | 1439 | hFzd1L, mFzd1L |
| 033S-G02 | hFzd1L | GTFSSYAIS | 48 | GIINPNDGNTRHA | 744 | CARRSSGWYEVDYW | 1440 | hFzd1L, mFzd1L |
| 033S-H02 | hFzd1L | YTFTSYYMH | 49 | GIINPNGGSTIYA | 745 | CAREVATISSDDAQYYFDYW | 1441 | hFzd1L, mFzd1L |
| 033S-A03 | hFzd1L | GTFSSYAIS | 50 | GGIIPIFGTANYA | 746 | CARRPLWWHVAGVYYMDVW | 1442 | hFzd1L, mFzd1L |
| 033S-B03 | hFzd1L | YTFTGQYMH | 51 | GGIIPIFGTAHYP | 747 | CARRSVAAGTPFTDYW | 1443 | hFzd1L, mFzd1L |
| 034S-C01 | hFzd1L | YDFTDHFVH | 52 | GGIIPIFGTANYA | 748 | CARRSMIAATDAFDMW | 1444 | hFzd1L, mFzd1L |
| 033S-E03 | hFzd1L | FTRSSAVQ | 53 | GIINPSGGSTSYA | 749 | CARRSKYSSSSGNEYFDIW | 1445 | hFzd1L, mFzd1L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 034S-E01 | hFzd1L | FSFENYWMS | 54 | SSINNSGDTYYA | 750 | CARAFNGMDVW | 1446 | hFzd1L, mFzd1L |
| 034S-F01 | hFzd1L | GTFSNYAIS | 55 | GIINPSSGSTNYA | 751 | CAARRRWEPRR RDFDLW | 1447 | hFzd1L, mFzd1L |
| 034S-H01 | hFzd1L | YRFTDYYFY | 56 | GGINPNSGGTNYA | 752 | CTARDPTFRGP GMDVW | 1448 | hFzd1L, mFzd1L |
| 034S-A02 | hFzd1L | YIFTNYXIQ | 57 | GIINPDYGNTMYA | 753 | CASTGTTVTTR GNDYW | 1449 | hFzd1L, mFzd1L |
| 034S-B02 | hFzd1L | DTFTGYYIH | 58 | GIINPSGGSTSYA | 754 | CARASWFGEGR QNDPW | 1450 | hFzd1L, mFzd1L |
| 034S-C02 | hFzd1L | HTFSDXYMH | 59 | GIINPSSGRTYHA | 755 | CARGSGWKHAE YFQHW | 1451 | hFzd1L, mFzd1L |
| 034S-E02 | hFzd1L | HTFTGYYIH | 60 | GIINPSGGSTYHA | 756 | CARASGFGEGQ HFHPW | 1452 | hFzd1L |
| 034S-F02 | hFzd1L | YPFIGQYIH | 61 | GGIIPISGTASYA | 757 | CARGVEPYYGM DVW | 1453 | hFzd1L |
| 037S-D01 | hFzd1L | GTFTSYYMH | 62 | GIINPSGGSTSYA | 758 | CARRRIAAAGV DAFDIW | 1454 | hFzd1L |
| 037S-E01 | hFzd1L | YTFTGYYVH | 63 | GGIIPMSGSPSYA | 759 | CARRRVAAHST HDAFDIW | 1455 | hFzd1L |
| 037S-F01 | hFzd1L | YTFTSYYMH | 64 | GIINPSGGSTSYA | 760 | CARDIRSGYSY AWSPW | 1456 | hFzd1L |
| 037S-G01 | hFzd1L | YTFRRYGIS | 65 | GWINPNSGGTNYA | 761 | CARFYTAGDYW | 1457 | hFzd1L |
| 037S-H01 | hFzd1L | NNFGSYAIT | 66 | GIINPSGGSTRYA | 762 | CARRAYSSRDG MDVW | 1458 | hFzd1L |
| 037S-A02 | hFzd1L | YTFTYYHMH | 67 | GWINPNSGGTNLA | 763 | CARARGYRAFD IW | 1459 | hFzd1L |
| 037S-B02 | hFzd1L | YTFTNYAMH | 68 | GWMNPNSGNTGSA | 764 | CARDGQQLEAF QHW | 1460 | hFzd1L |
| 032S-E01 | mFzd1L | DTFTSYYMH | 69 | GIISPSGGTTAYA | 765 | CARRAYSSSWY GYDAFDIW | 1461 | hFzd1L, mFzd1L |
| 032S-E01 | mFzd1L | YTFTNHWMH | 70 | GWISASNGNTNYA | 766 | CARDDVDSNYV GGMDVW | 1462 | hFzd1L, mFzd1L |
| 032S-F01 | mFzd1L | YTFTNYYIH | 71 | GWISAYNGNTNYA | 767 | CARDTGTTRTY YYGMDVW | 1463 | mFzd1L |
| 032S-C02 | mFzd1L | YTFTSYDIN | 72 | GWMNPNSGNTGYA | 768 | CARDLDGMDVW | 1464 | mFzd1L |
| 032S-E02 | mFzd1L | YTFPAXYMH | 73 | GWISAYNGNTNYA | 769 | CARDTGPKSYS SNAYGMDVW | 1465 | mFzd1L |
| 032S-G02 | mFzd1L | YTFTGYYMH | 74 | GIINPGGGGTSYA | 770 | CARDSGSNGYS FDIW | 1466 | mFzd1L |
| 031S-D01 | hFzd2ext | FTFGDHAIS | 75 | SAISGSGGSTYYA | 771 | CAKSRAAHGYF DYW | 1467 | hFzd1L, 2L, 7L |
| 031S-E01 | hFzd2ext | FTFSPYGMH | 76 | SSISSSSSYIYYA | 772 | CARAGGSVENL GGDYW | 1468 | hFzd1L, 2L, 7L |
| 031S-F01 | hFzd2ext | XTFTDYAMD | 77 | GWINPNSGNTGYA | 773 | CARYSSSWYAF DIW | 1469 | hFzd2L |
| 031S-G01 | hFzd2ext | DTFSRSVFS | 78 | GWISAYNGNTNYA | 774 | CARDYGDYTQS NDYW | 1470 | hFzd2L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 031S-B02 | hFzd2ext | FTFSSYXMS | 79 | SAIGGSGANAYYA | 775 | CVRDTNWAFDL W | 1471 | hFzd2L |
| 034S-H02 | hFzd2L | YTFTSYYMH | 80 | GWMNPNSGNTGYA | 776 | CARDGKSIAVA GLDYW | 1472 | hFzd2L |
| 034S-F03 | hFzd2L | YTFSSYYIH | 81 | GWMNPKSGNTGNA | 777 | CAREGRISYGM DVW | 1473 | hFzd2L |
| 034S-C09 | hFzd2L | YTFTGYYMH | 82 | GKINPTGGSTSYA | 778 | CAREWFDPW | 1474 | hFzd2L, mFzd2L |
| 034S-D09 | hFzd2L | YTFTSYYMH | 83 | GIINPNGGNTSYA | 779 | CARERAGVLSY FDLW | 1475 | hFzd2L, mFzd2L |
| 034S-E09 | hFzd2L | FTFSSYXMS | 84 | SAIGGIGDSTYYA | 780 | CARDTDVAIDY W | 1476 | hFzd2L, mFzd2L |
| 034S-F09 | hFzd2L | FTFSSYXMS | 85 | SAIGGIGDSTYYA | 781 | CARDTDVAIDY W | 1477 | hFzd2L, mFzd2L |
| 034S-A10 | hFzd2L | YTFTGYYMH | 86 | GWMNPNTGNTGYA | 782 | CARDRVYGMDV W | 1478 | hFzd2L, mFzd2L |
| 034S-D10 | hFzd2L | YTFTSYGTS | 87 | GWMNPNSGNTVYA | 783 | CARDWDLLDYW | 1479 | hFzd2L, mFzd2L |
| 034S-C11 | hFzd2L | YTFTSYYMH | 88 | GWMNPNSGNTGYA | 784 | CAREPLWFGES SPHDYYGMDVW | 1480 | hFzd2L, mFzd2L |
| 034S-C12 | hFzd2L | YTFTSYHIH | 89 | GGIIPISGTAKYV | 785 | CARDSIRIGFD YW | 1481 | mFzd2L |
| 034S-F12 | hFzd2L | GTFSSYAIS | 90 | GGIIPSFGSAKYA | 786 | CARGMYDYVWG RYPKGFDPW | 1482 | mFzd2L |
| 034S-G12 | hFzd2L | YTFTGYYMH | 91 | GWMNPNTGNTGYA | 787 | CARDRVYGMDV W | 1483 | mFzd2L |
| 03SS-D01 | hFzd2L | YTFTSYYMH | 92 | GIINPSGGSTSYA | 788 | CARERAGVLSY FDLW | 1484 | mFzd2L |
| 036S-A01 | hFzd2L | RTFSIKPMG | 93 | ATIGSGALTNYA | 789 | CNTVPPTTYHS GTFFPEGYW | 1485 | hFzd2L, mFzd2L |
| 037S-C02 | hFzd2L | YTFTGYYMH | 94 | GKINZTGGSTZYA | 790 | CAREWFDPW | 1486 | hFzd2L |
| 037S-G02 | hFzd2L | FTFSDHYMS | 95 | SAIDNSGHRTWYA | 791 | CATDNERAFDI W | 1487 | hFzd2L |
| 037S-A03 | hFzd2L | YTFTTYYLH | 96 | GIINPNGGSTSYA | 792 | CAKENSYGMDV W | 1488 | hFzd2L |
| 037S-C03 | hFzd2L | YTFTGYPIH | 97 | GWISGYNGNTNYA | 793 | CARDSAGTTGY YYYGMDVW | 1489 | hFzd2L |
| 037S-D03 | hFzd2L | YTFTSYYMH | 98 | GIINPSGGSTSYA | 794 | CARAHWNYQGD AFDIW | 1490 | hFzd2L |
| 037S-E03 | hFzd2L | YTFTGYYMH | 99 | GKINPTGGSTZYA | 795 | CAREWFDPW | 1491 | hFzd2L |
| 037S-H03 | hFzd2L | YTFTGYYVH | 100 | GGIIPMSGSPSYA | 796 | CARRRVAAHST HDAFDIW | 1492 | hFzd2L |
| 037S-B04 | hFzd2L | YTZTSYYMH | 101 | GWMNPNSGNTGYA | 797 | CAREKLGLGSG YFDYW | 1493 | hFzd2L |
| 037S-F04 | hFzd2L | YTFTSYYMH | 102 | GWMNPDSGDTGYA | 798 | CARDQEDYYGM DVW | 1494 | hFzd2L |
| 037S-H04 | hFzd2L | GTFSSYAIS | 103 | GWINPNSGGTNYA | 799 | CARNYYGSGSY IDYW | 1495 | hFzd2L, mFzd2L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 037S-F05 | hFzd2L | YTFTGYYMH | 104 | GWMSPASGNTGYA | 800 | CARDTDQWEHG YFDLW | 1496 | hFzd2L |
| 048S-E01 | hFzd2L | YTFTSYYMH | 105 | GWMNPNSGNTGYA | 801 | CARELGSGSYL SGYYYYGMDVW | 1497 | hFzd2L |
| 048S-C01 | hFzd2L | GTFSSYAIS | 106 | GWISGYNGNTNYA | 802 | CAREALRHYYY GMDVW | 1498 | HFzd2L |
| 048S-G01 | hFzd2L | YTFTHYYMH | 107 | GWINPNGGNTSYA | 803 | CARENVNSGFY YYGMDVW | 1499 | hFzd2L |
| 048S-D01 | hFzd2L | YTLTHYYMH | 108 | GWMNPNSGNTGYA | 804 | CARETVSSGYY YYGMDVW | 1500 | hFzd2L |
| 048S-B02 | hFzd2L | YTFTGYYMH | 109 | GKINPTGGSTSYA | 805 | CAREWFDPW | 1501 | hFzd2L |
| 048S-F01 | hFzd2L | YTFTGTYMH | 110 | GWISAYNGNTNYA | 806 | CARDTAVAGID YW | 1502 | hFzd2L |
| 048S-H01 | hFzd2L | YTFTSYYMH | 111 | GWMNPDSGDTGYA | 807 | CARDQEDYYGM DVW | 1503 | hFzd2L |
| 048S-A02 | hFzd2L | FTFSSSWMH | 112 | SAISFSGGSTYYA | 808 | CARSYGDYGFD YW | 1504 | hFzd2L |
| 048S-C02 | hFzd2L | YSFNGYYMH | 113 | GWINPKSGGTTYA | 809 | CASEYSSPRGG VGMDVW | 1505 | hFzd2L |
| 048S-E02 | hFzd2L | FTFSSYGMH | 114 | SYITGSGSTRYYA | 810 | CARRQYCSSTS CYYGMDVW | 1506 | hFzd2L |
| 048S-A01 | hFzd2L | YTFSSYYIH | 115 | GWMNPKSGNTGNA | 811 | CAREGRLSYGM DVW | 1507 | hFzd2L, mFzd2L |
| 049S-A01 | hFzd2L | FZZSSYXMS | 116 | SAIGGIGDSTYYA | 812 | CARDTDVAIDY W | 1508 | hFzd2L, mFzd2L |
| 049S-C01 | hFzd2L | YTFTKDYMH | 117 | GWMNPSSGNTGYA | 813 | CAREKVTPHYY YYYGMDVW | 1509 | hFzd2L, mFzd2L |
| 049S-D01 | hFzd2L | FAFSSYXMN | 118 | STISGGGVSTYYA | 814 | CAREDSSSWYA FDYW | 1510 | hFzd2L, mFzd2L |
| 049S-E01 | hFzd2L | YTFTGYYMH | 119 | GWMNPNTGNTGYA | 815 | CARDRVYGMDV W | 1511 | hFzd2L, mFzd2L |
| 044S-G10 | mFzd3L | YTFTTYYMH | 120 | GIINPSGGSTRYA | 816 | CARLPTNDYGD YVDYW | 1512 | hFzd3L, hFzd6L |
| 044S-H10 | mFzd3L | YTFTSYYMH | 121 | GIINPSGGSTSYA | 817 | CARIGYW | 1513 | mFzd3L |
| 044S-A11 | mFzd3L | GTFTRYTMH | 122 | GWMNPNSGNTAYA | 818 | CASQDVW | 1514 | mFzd3L |
| 044S-B11 | mFzd3L | DTFSTYAIS | 123 | GWMNPNSGKTGYA | 819 | CAKASGGAVLD YW | 1515 | hFzd3L, mFzd3L |
| 044S-C11 | mFzd3L | FTFSNAWMS | 124 | SAISRGGDNTYYA | 820 | CAREEGLWFRE LSYYYYYGMDV W | 1516 | hFzd3L, hFzd6L |
| 044S-E11 | mFzd3L | GTFSSYAIS | 125 | GWMNPTNGNTGYA | 821 | CASSRRHYGMD VW | 1517 | hFzd3L, hFzd6L |
| 044S-F11 | mFzd3L | FRFSDYSMN | 126 | SSISGSGGYTYYA | 822 | CARGPLCSGGS CYYGMDVW | 1518 | hFzd3L, mFzd3L |
| 044S-G11 | mFzd3L | GTFSSYAIS | 127 | GWMNPNSGNTGYA | 823 | CARDGGYDALV GYYYGMDVW | 1519 | hFzd3L, mFzd3L |
| 044S-H11 | mFzd3L | YTFTGHYMH | 128 | GWISAYNGNTNYA | 824 | CAARGYW | 1520 | hFzd3L, mFzd3L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 044S-B12 | mFzd3L | FTFKEHGMH | 129 | SYISSGSSYIYYA | 825 | CAKQPYRGSGM DVW | 1521 | hFzd3L, mFzd3L |
| 044S-C12 | mFzd3L | GTFSSYAIS | 130 | GWMNPNSGNTGYA | 826 | CATDSLLAAAG TDYYYGMDVW | 1522 | hFzd3L, mFzd3L |
| 044S-D12 | mFzd3L | YAF1SYYMH | 131 | GIINPSGGSTIYA | 827 | CARGPWLHGFD YW | 1523 | hFzd3L, hFzd6L |
| 044S-E12 | mFzd3L | YTFTGYYMH | 132 | GVINPSGGGRTYA | 828 | CARGPLIRFHY YYGMDVW | 1524 | hFzd3L, mFzd3L |
| 044S-F12 | mFzd3L | GTFNSYAIS | 133 | GWINPASGGTKYA | 829 | CASTTTVASMD VW | 1525 | hFzd3L, hFzd6L |
| 045S-A01 | mFzd3L | GTFSSYAIN | 134 | GWMNPNSGNTGYA | 830 | CARVIYRENSG WSDFDYW | 1526 | hFzd3L, mFzd3L |
| 045S-B01 | mFzd3L | FTFSNHYTS | 135 | SAISTGGGTTYYA | 831 | CARDLGGYGMD VW | 1527 | hFzd3L, hFzd6L |
| 045S-C01 | mFzd3L | YTFTSYHMH | 136 | GWINPNSGGTNYA | 832 | CATRQAW | 1528 | hFzd3L, mFzd3L |
| 045S-D01 | mFzd3L | GTFSNYGVS | 137 | GRINPNSGNTGYA | 833 | CRGRFDPW | 1529 | hFzd3L, mFzd3L |
| 045S-E01 | mFzd3L | YPFTNNYIH | 138 | GWISPHSGRTRYA | 834 | CARDRTRYGMD VW | 1530 | hFzd3L, mFzd3L |
| 045S-G01 | mFzd3L | DTFTKYAIH | 139 | GWMNPNSGNTGYA | 835 | CARDRVVPAAT YYYYYYMDVW | 1531 | hFzd3L, mFzd3L |
| 045S-H01 | mFzd3L | GTFSSYAIS | 140 | GWMNPNSGNTGYG | 836 | CARVXGGSGWK RYFDLW | 1532 | hFzd3L, mFzd3L |
| 045S-A02 | mFzd3L | YTFTGHYLH | 141 | GWMNPSSGNTGYA | 837 | CARDWYGSGSY YSGDYYMDVW | 1533 | hFzd3L, mFzd3L |
| 045S-B02 | mFzd3L | GTFTAYYLH | 142 | GWMNPNSGNTGYA | 838 | CAREGYDILTG PGGMDVW | 1534 | hFzd3L, mFzd3L |
| 045S-D02 | mFzd3L | YTFTGYFIH | 143 | GRISGYNGNTNYA | 839 | CARGQSGIW | 1535 | hFzd3L, mFzd3L |
| 045S-E02 | mFzd3L | GTFSSYAIS | 144 | GWMNPNSGNAGYA | 840 | CARTLYSSGWA RYFDLW | 1536 | hFzd3L, mFzd3L |
| 045S-F02 | mFzd3L | GTFDNYAIS | 145 | GWMNPNSGNTGLV | 841 | CARTPRVAGTF DYW | 1537 | hFzd3L, mFzd3L |
| 045S-G02 | mFzd3L | GTFSNYAIN | 146 | GWMNPNSGNTGSA | 842 | CASSSYSSGWY PIQHW | 1538 | hFzd3L, mFzd3L |
| 045S-H02 | mFzd3L | GTFSNYAIS | 147 | GIVDPMTGSTSYA | 843 | CARSRGVLWAR GIDYW | 1539 | hFzd3L, mFzd3L |
| 045S-A03 | mFzd3L | FTFSNSDMN | 148 | SSISSSGGSTYYA | 844 | CARDLIMDVW | 1540 | hFzd3L, mFzd3L |
| 045S-B03 | mFzd3L | FTFSPYAMH | 149 | SAISGSGGSTYYA | 845 | CARENYGMDVW | 1541 | hFzd3L, mFzd3L |
| 045S-C03 | mFzd3L | FTFSSYAMH | 150 | SAISGSGGSTYYA | 846 | CASRGTGYSSS FDYW | 1542 | hFzd3L, mFzd3L |
| 045S-D03 | mFzd3L | GTFSSYAIS | 151 | GWISAYSGNTKYA | 847 | CARGRVATEKH WYFDLW | 1543 | hFzd3L, mFzd3L |
| 045S-F03 | mFzd3L | GTFSRNGIS | 152 | GWINSNNGETDFA | 848 | CARGGYW | 1544 | hFzd3L, mFzd3L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 045S-G03 | mFzd3L | GTFRSHVIS | 153 | GWMNPNSGYTGYA | 849 | CARSRDYGGNS AVGYW | 1545 | hFzd3L, mFzd3L |
| 045S-H03 | mFzd3L | YTFMSYYVH | 154 | GWINPNTGGTNFA | 850 | CARGRGNRGYS YGYEAVADDYW | 1546 | hFzd3L, mFzd3L |
| 045S-A04 | mFzd3L | DTFSHYAFS | 155 | GWISAYNGNTKYA | 851 | CARESGYDPYY GMDVW | 1547 | hFzd3L, hFzd6L |
| 045S-B04 | mFzd3L | DTFDTYAIS | 156 | GWMNRNSGNTGYA | 852 | CARHLNIAARR EGFWYFDLW | 1548 | hFzd3L, mFzd3L |
| 045S-D04 | mFzd3L | YTFTSYYMH | 157 | GSINTGGGGTTYA | 853 | CATGRVRDYW | 1549 | hFzd3L, mFzd3L |
| 045S-E04 | mFzd3L | FTFSSYGMH | 158 | AVISHDGRKKYYA | 854 | CAGGSYSYDYW | 1550 | hFzd3L, mFzd3L |
| 045S-F04 | mFzd3L | YSFTRYHMH | 159 | GWINPNSGGTNYA | 855 | CARGQSGIW | 1551 | hFzd3L, mFzd3L |
| 045S-G04 | mFzd3L | GRFSRYAIS | 160 | GWINPNSGNTGNA | 856 | CARLDYYYGMD VW | 1552 | hFzd3L, mFzd3L |
| 045S-H04 | mFzd3L | GTFSSYPIS | 161 | GWMNPNSGNTGYA | 857 | CARSHSSSLLD YW | 1553 | hFzd3L, mFzd3L |
| 045S-B05 | mFzd3L | FTFSSYXMS | 162 | SVISGSGGSTYYA | 858 | CARDRGGYGMD VW | 1554 | hFzd3L, mFzd3L |
| 045S-B05 | mFzd3L | GTFSSYPLS | 163 | GWMNPNSGNTGYA | 859 | CARGGYNSPLR YW | 1555 | hFzd3L, mFzd3L |
| 045S-C05 | mFzd3L | YTFTSYYMH | 164 | GIINPSGGSTRYA | 860 | CARGKDVW | 1556 | hFzd3L, mFzd3L |
| 045S-D05 | mFzd3L | GTFSTHAIS | 165 | GWMNPNSGNTGYA | 861 | CAKAGYTAVLD LW | 1557 | hFzd3L, mFzd3L |
| 045S-E05 | mFzd3L | YTFTTYYIH | 166 | GRMDPNSGKTDSA | 862 | CARGLSW | 1558 | hFzd3L, mFzd3L |
| 045S-F05 | mFzd3L | NTFTGYYIH | 167 | GIINPSNGRTSYA | 863 | CAKDGTGKGVS PLGYW | 1559 | hFzd3L, mFzd3L |
| 045S-G05 | mFzd3L | GTFSSYAIS | 168 | GWMNPNSGNTGYA | 864 | CARARGNVGYF DYW | 1560 | hFzd3L, mFzd3L |
| 045S-A06 | mFzd3L | FTFSSYAMH | 169 | SSISSSSSYIYYA | 865 | CARGGGYSSSS SEGMDVW | 1561 | hFzd3L, mFzd3L |
| 045S-B06 | mFzd3L | FIFSNYAMH | 170 | SAIGTGGGTYYA | 866 | CAREVRHSSSY YYYYYGMDVW | 1562 | hFzd3L, mFzd3L |
| 045S-C06 | mFzd3L | FTFSSAWMS | 171 | SAISGNSVSTYYA | 867 | CARDLGGYGMD VW | 1563 | hFzd3L, mFzd3L |
| 045S-D06 | mFzd3L | GZFQXVLIS | 172 | GWMNPNSGNTZYA | 868 | CAVLAPHVGFD PW | 1564 | hFzd3L, mFzd3L |
| 045S-E06 | mFzd3L | FTFSSYXMS | 173 | SAISGTGRSTYYA | 869 | CAKDRYDYAFF DYW | 1565 | hFzd3L, mFzd3L |
| 045S-G06 | mFzd3L | FTFSSYAMH | 174 | SRINSDGSRTNYA | 870 | CAGFDYW | 1566 | hFzd3L, mFzd3L |
| 045S-H06 | mFzd3L | FTFSNHYTS | 175 | SAISGSSGNTYYA | 871 | CARDGGGYGMD VW | 1567 | hFzd3L, mFzd3L |
| 045S-A07 | mFzd3L | FTFSSYXMS | 176 | SAISGSGGSTYYA | 872 | CARDQGGYGMD VW | 1568 | mFzd3L |

TABLE 2-continued

Clone IDs and CDR sequences for hinge specific ("L") or hinge (L) + CRD ("ext") binders. "CDRH" indicates heavy chain CDRs, and "CDRL" indicates light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|----------|---------|-------|--------------|-------|--------------|-------|--------------|-------------------|
| 045S-C07 | mFzd3L | GTFSSYAIS | 177 | GWMNPNSGNTGYA | 873 | CARISSGYDFD YW | 1569 | hFzd3L, mFzd3L |
| 044S-D01 | hFzd3L | GTFSSYAIS | 178 | GWMSPNSGNTGYA | 874 | CARFKGIAAAG KYYYYYGMDVW | 1570 | hFzd3L, mFzd3L |
| 044S-EO1 | hFzd3L | DTFDTYAIS | 179 | GGINPSSGSTTYA | 875 | CARVPPAVAGQ PIDYW | 1571 | hFzd3L, mFzd3L |
| 044S-F01 | hFzd3L | GTFSSYAIS | 180 | GWMNPNSGNTGYA | 876 | CANLGYSSGTY YFDYW | 1572 | hFzd3L, mFzd3L |
| 044S-G01 | hFzd3L | YTFTNYFMH | 181 | GIINPSGGSTSYA | 877 | CARDDGGGMDV W | 1573 | hFzd3L, mFzd3L |
| 044SA02 | hFzd3L | GTFSSYAIS | 182 | GWMNPNSGNTGYA | 878 | CARAKYYYDMD VW | 1574 | hFzd3L, mFzd3L |
| 044S-B02 | hFzd3L | FNFRMRPMH | 183 | SYISGNSGYTNYA | 879 | CARGPNWFDPW | 1575 | hFzd3L, mFzd3L |
| 044S-C02 | hFzd3L | YTFTAYYMH | 184 | GIINPSGGSTSYA | 880 | CARDRTGRWDV W | 1576 | hFzd3L, mFzd3L |
| 044S-D02 | hFzd3L | YTFTNYYMH | 185 | GRMNPNSGNTVYA | 881 | CASRGGDGMDV W | 1577 | hFzd3L, mFzd3L |
| 044S-E02 | hFzd3L | FTVSDKYMS | 186 | AVISYDGSNKYYA | 882 | CAREGYSSSWY SPEYFQHW | 1578 | hFzd3L, mFzd3L |
| 044S-F02 | hFzd3L | FPFSSYAMS | 187 | SFISGSGGSTDYA | 883 | CARAVRGVTPL GYW | 1579 | hFzd3L, mFzd3L |
| 044S-H02 | hFzd3L | FTFSSYAMH | 188 | AVISYDGSNKYYA | 884 | CARSTRGVGLD YW | 1580 | hFzd3L, hFzd6L |
| 044S-B03 | hFzd3L | YTFTGYYMH | 189 | GRINPANGNASYA | 885 | CARGSRHC | 1581 | hFzd3L, hFzd6L |
| 044S-C03 | hFzd3L | YTFTGYYMH | 190 | GRINPDSGYTNYA | 886 | CAHLKDDYW | 1582 | hFzd3L, hFzd6L |
| 044S-D03 | hFzd3L | FTFSNHYMS | 191 | SAIGTGGGTYYA | 887 | CARGGRYQGNW | 1583 | hFzd3L, mFzd3L |
| 044S-E03 | hFzd3L | YTFTSYYMH | 192 | GIINPRRGSTRYA | 888 | CARDGVDRFDY W | 1584 | hFzd3L, mFzd3L |
| 044S-F03 | hFzd3L | FTFSNYAMH | 193 | SAISGSGGSTYYA | 889 | CAREEYGMDVW | 1585 | hFzd3L, hFzd6L |
| 044S-G03 | hFzd3L | FTFNNYAMS | 194 | TVISSDGSTKSYA | 890 | CARALEWPNSG YFDYW | 1586 | hFzd3L, mFzd3L |
| 044S-A04 | hFzd3L | YTFTRYAMH | 195 | GWMNPNSGNTGYA | 891 | CARDIIFRGSG YGMDVW | 1587 | hFzd3L, mFzd3L |
| 044S-C04 | hFzd3L | YIFTNHYIH | 196 | GWMNPSSGNTGYA | 892 | CAIQDVW | 1588 | hFzd3L, hFzd6L |
| 044S-D04 | hFzd3L | GTFSSYAIN | 197 | GWINPNSGNTGYA | 893 | CARGPYSRTVP YYYGMDVW | 1589 | hFzd3L, hFzd6L |
| 044S-A01 | hFzd3L | YTFTSYGIS | 198 | GGIIPM5GTSNYA | 894 | CARGKHYW | 1590 | hFzd3L |
| 044S-B01 | hFzd3L | YTFTGYYVH | 199 | GWINPKNGGTHYA | 895 | CARSGSERLSG YSPR | 1591 | mFzd3L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 044S-C01 | hFzd3L | FTFSSSWMH | 200 | ASISSSSSHIYYA | 896 | CARLTTSTVTT QYWYFDLW | 1592 | mFzd3L |
| 044S-G02 | hFzd3L | FTFNNYZMS | 201 | TVISSDGSTZSYA | 897 | CARALEWPNSG YFDYW | 1593 | hFzd3L, mFzd3L |
| 044S-H03 | hFzd3L | FSFINYAMH | 202 | SSISSSSSYIYYA | 898 | CARGLYGAFQY W | 1594 | mFzd3L |
| 044S-B04 | hFzd3L | FTFNNYAMS | 203 | SAISGSGGSTYYA | 899 | CARGIGYMDVW | 1595 | mFzd3L |
| 044S-G04 | hFzd3L | YTFVRYGIT | 204 | GWINPNSGGTNYA | 900 | CARINGTIVAS YYYYGMDVW | 1596 | mFzd3L |
| 044S-H04 | hFzd3L | DTFSNYYMH | 205 | GLITPSGDYATYA | 901 | CASHRHW | 1597 | hFzd3L, mFzd3L |
| 044S-A05 | hFzd3L | YTFTDYSIH | 206 | GGIIPVIGTTKYA | 902 | CAHVPPTGAAG AFDIW | 1598 | hFzd3L, mFzd3L |
| 044S-B05 | hFzd3L | YTFSSYYMH | 207 | GIINPNGGGTRYA | 903 | CARHNYDSYYY YGMDVW | 1599 | mFzd3L hFzd3L, |
| 044S-C05 | hFzd3L | GTFSSYAIS | 208 | GWMNPNSGNTGFA | 904 | CARLGLEWEFD YW | 1600 | mFzd3L hFzd3L, |
| 044S-D05 | hFzd3L | GTFSSYAIS | 209 | GKINPRDGSTTYA | 905 | CARGSGGGW | 1601 | hFzd6L |
| 044S-E05 | hFzd3L | FTFSSYXMS | 210 | STISGNGGRTYYA | 906 | CARTGDGMDVW | 1602 | hFzd3L, mFzd3L |
| 044S-G05 | hFzd3L | YTFTSYSMH | 211 | GWMNPNTGNTGYA | 907 | CATVPSGSYWV DYW | 1603 | hFzd3L, hFzd6L |
| 044S-H05 | hFzd3L | FTFSSYXMS | 212 | SAISGSGGSTYYA | 908 | CARDTGGTFNY W | 1604 | hFzd3L, mFzd3L |
| 044S-A06 | hFzd3L | FSLSSSGMS | 213 | SAISRSGATTYYS | 909 | CARPRVEAFDI W | 1605 | hFzd3L, mFzd3L |
| 044S-B06 | hFzd3L | YTFSMYYMH | 214 | GWINPKSGGTNYA | 910 | CARDYSNYAFA SYYYYMDVW | 1606 | hFzd3L, mFzd3L |
| 044S-C06 | hFzd3L | GTFSRYAIS | 215 | GWMNPNSGNTGYA | 911 | CARMAYSYGYD WFDPW | 1607 | hFzd3L, mFzd3L |
| 044S-D06 | hFzd3L | YTFTNYFFH | 216 | GWMNPHSGNTGYA | 912 | CAREYYYYGMD VW | 1608 | hFzd3L, mFzd3L |
| 044S-E06 | hFzd3L | YTFTSYYMH | 217 | GMINPSGQSTTYA | 913 | CARGGVW | 1609 | hFzd3L, mFzd3L |
| 044S-F06 | hFzd3L | YTFTTHYMH | 218 | GIINPSGGTTNYA | 914 | CARDRYCSGGS CTGLFDYW | 1610 | hFzd3L, mFzd3L |
| 044S-G06 | hFzd3L | YTFSHHYVH | 219 | GWISAYNGKTNYA | 915 | CAREGGGMDVW | 1611 | hFzd3L, mFzd3L |
| 044S-H06 | hFzd3L | YSFTNYYLH | 220 | GWMNPNSGNTGYA | 916 | CARDPYGSGTG GMDVW | 1612 | hFzd3L, mFzd3L |
| 044S-A07 | hFzd3L | YTFSHYGMH | 221 | AAVSRSGGSTFYA | 917 | CARGGMDVW | 1613 | hFzd3L, mFzd3L |
| 044S-B07 | hFzd3L | GTFSSYAIS | 222 | GVINPSGGSTSYA | 918 | CASRVSRSW | 1614 | hFzd3L, mFzd3L |
| 044S-C07 | hFzd3L | FTFSSFAMH | 223 | SGINWNGGSTGYA | 919 | CARDHPPRSSS RYFGIW | 1615 | hFzd3L, mFzd3L |
| 044S-D07 | hFzd3L | YDFINYYIH | 224 | GWISGYNGNTNYA | 920 | CAREKQGMDVW | 1616 | hFzd3L, mFzd3L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 044S-E07 | hFzd3L | YTFTYRYIH | 225 | GIINPDTGSATYA | 921 | CARGTGSGSSW | 1617 | hFzd3L, mFzd3L |
| 044S-F07 | hFzd3L | YTFTSYYMH | 226 | GWMNPNSGNTGYV | 922 | CARALSRGNYW | 1618 | hFzd3L, mFzd3L |
| 044S-G07 | hFzd3L | FTFTSSAVQ | 227 | GWISAYSGNTNYA | 923 | CARVGVGGYSY GLPYYYMDVW | 1619 | mFzd3L |
| 044S-H07 | hFzd3L | YTFTTHYMH | 228 | GMINPSGGSTSYA | 924 | CARGICTNW | 1620 | hFzd3L, mFzd3L |
| 044S-A08 | hFzd3L | FTFGSHGMH | 229 | SGISSNGGSTYYA | 925 | CARGGRRSSGW YGVDYW | 1621 | hFzd3L, mFzd3L |
| 044S-B08 | hFzd3L | GSFTSHAVT | 230 | GWMNPNSGNTGYA | 926 | CARVIIYGMDV W | 1622 | mFzd3L |
| 044S-C08 | hFzd3L | GTFSRNAIS | 231 | GWMNPNSGNTGYA | 927 | CARDTGGYMDV W | 1623 | hFzd3L, mFzd3L |
| 044S-E08 | hFzd3L | YTFTDNYIH | 232 | GMINPSGGSTSYA | 928 | CARKGDYW | 1624 | hFzd3L, mFzd3L |
| 044S-F08 | hFzd3L | GRFSTYAIS | 233 | GWMNPNSGNTGYA | 929 | CARIGYYYMDV W | 1625 | hFzd3L, mFzd3L |
| 044S-G08 | hFzd3L | FTYDDHAMH | 234 | SAISGGGGSTYYA | 930 | CARGDLRWRGW YFDLW | 1626 | hFzd3L, mFzd3L |
| 044S-A09 | hFzd3L | YTFTSYYMH | 235 | GLINPSGGSTRYA | 931 | CARDYGDIGFD YW | 1627 | hFzd3L, mFzd3L |
| 044S-B09 | hFzd3L | YPFSNYYMH | 236 | GIINSRRGSTRYA | 932 | CARDHGDAFDI W | 1628 | hFzd3L, mFzd3L |
| 044S-C09 | hFzd3L | YTFTTYWIH | 237 | GVINPSGGSTSYA | 933 | CAROSGRYRGR YFDYW | 1629 | hFzd3L, mFzd3L |
| 044S-E09 | hFzd3L | FPFSSYGIH | 238 | SAISASGGGTYYA | 934 | CASGAAAFDIW | 1630 | hFzd3L, mFzd3L |
| 044S-F09 | hFzd3L | YTFTYRYIH | 239 | GRINTNSGDTNYA | 935 | CAREEHW | 1631 | hFzd3L, hFzd6L |
| 044S-G09 | hFzd3L | FTFSSDAMH | 240 | SAISGTTGRTYYA | 936 | CARDRYSSSWA HLYFDLW | 1632 | hFzd3L, mFzd3L |
| 044S-H09 | hFzd3L | FTFSTYPMH | 241 | AAIWNDGTNKYYA | 937 | CARVAARPQRA LGYW | 1633 | hFzd3L, hFzd6L |
| 044S-A10 | hFzd3L | YTFNSYYMH | 242 | GTINPRRGSTKYA | 938 | CARVANWAVDY W | 1634 | hFzd3L, mFzd3L |
| 044S-B10 | hFzd3L | GTFSSYAIS | 243 | GWINPNSGNRGYA | 939 | CARHRYSSSWN YGMDVW | 1635 | hFzd3L, mFzd3L |
| 044S-D10 | hFzd3L | YTFTSYYMH | 244 | GMINPRGGGTGYA | 940 | CARTSKDVGLF DYW | 1636 | hFzd3L, mFzd3L |
| 038S-B01 | hFzd4L | YTFTSYYMH | 245 | GWMNPSGGNTGYA | 941 | CARDGSLDLW | 1637 | hFzd4L |
| 038S-D01 | hFzd4L | YTFTGYYMH | 246 | GVINPSGGSTIYA | 942 | CAKVYKYYDYV WGSLDYW | 1638 | hFzd4L |
| 038S-D03 | hFzd4L | YTFTSYYMH | 247 | GRIIPNTGDTNYA | 943 | CATLPRGRGNY W | 1639 | hFzd4L |
| 038S-E02 | hFzd4L | YTFTGYYVH | 248 | GIINPSGGTTSYA | 944 | CAREGRYCSGG SCYSGWYFDLW | 1640 | hFzd4L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 038S-E03 | hFzd4L | YTFTNYYMH | 249 | GWMQGDSGNTGYA | 945 | CARDGSIDYW | 1641 | hFzd4L |
| 038S-E05 | hFzd4L | YTFTNYYMH | 250 | GWMNPNSGNTGYA | 946 | CARDASFDYW | 1642 | hFzd4L |
| 038S-A04 | hFzd4L | YTFTGYYMH | 251 | GWMNPNSGNTGYA | 947 | CARDGSMDVW | 1643 | hFzd4L |
| 038S-D04 | hFzd4L | YTFSSYYMH | 252 | GWZNPNGGNTZYA | 948 | CARDGSLDYW | 1644 | hFzd4L |
| 038S-E01 | hFzd4L | YTFTGYYMH | 253 | GWINPNSGNTGYA | 949 | CARGGNRDYR | 1645 | hFzd4L |
| 038S-C08 | hFzd4L | YTFTGYYMH | 254 | GWMNPNSGNTAYA | 950 | CAREGRYCSGG SCYSGWYFDLW | 1646 | hFzd4L |
| 038S-A03 | hFzd4L | YTFTGYYMH | 255 | GWINPNSGGTNYA | 951 | CAREARRGGWS TGYFDLW | 1647 | hFzd4L |
| 039S-B03 | hFzd4L | YTFTGYYMH | 256 | GWINPYSGGTSYA | 952 | CAREARRGGWS TGYFDLW | 1648 | hFzd4L |
| 038S-B02 | hFzd4L | FTFSNHYMS | 257 | SSISSSSSYIYYA | 953 | CARGPRTYSSS GFDYW | 1649 | hFzd4L |
| 038S-G03 | hFzd4L | YTFTSYYMH | 258 | GRIIPNTGDTSYA | 954 | CATLPRGKGNY W | 1650 | hFzd4L |
| 039S-B06 | hFzd4L | FTFSNHYMS | 259 | SSISSGSGYIYYA | 955 | CAKGPSSGWYV FDYW | 1651 | hFzd4L |
| 038S-C02 | hFzd4L | FTFSSYXMS | 260 | SAISGSGGSTYYA | 956 | CARDRGRWYGE NWFDPW | 1652 | hFzd4L |
| 039S-B02 | hFzd4L | YTFTSYYMH | 261 | GWMNPNSGNTGYA | 957 | CARDYGGYDYW | 1653 | hFzd4L |
| 038S-B04 | hFzd4L | YTFTSYYMH | 262 | GWINPNSGGTNYA | 958 | CARGRGGGYRG GYW | 1654 | hFzd4L |
| 039S-G02 | hFzd4L | FTFSNHYTS | 263 | ASISSSSSYIYYA | 959 | CARDVMVRGVD YYGMDVW | 1655 | hFzd4L |
| 039S-F04 | hFzd4L | YTFTSYYMH | 264 | GWMNPNSGNTGYA | 960 | CARDGSMDVW | 1656 | hFzd4L |
| 038S-B08 | hFzd4L | YTFTGYYMH | 265 | GWMNPNSGNTGYA | 961 | CARDGSMDVW | 1657 | hFzd4L |
| 038S-C10 | hFzd4L | YTFTNYYMH | 266 | GVINPSGGSTVYA | 962 | CARHDRHDYGD LDYW | 1658 | hFzd4L |
| 038S-F06 | hFzd4L | FTFSSYAMH | 267 | SGITGSGGATYYA | 963 | CARDGDYVSGY GMDVW | 1659 | hFzd4L |
| 038S-F07 | hFzd4L | FTFSSYGMH | 268 | SAISGSGGSTYYA | 964 | CARRLQAVHWF DPW | 1660 | hFzd4L |
| 038S-H06 | hFzd4L | YTFTSYYMH | 269 | GWMNPNSGNTGYA | 965 | CARDGSMDVW | 1661 | hFzd4L |
| 038S-G07 | hFzd4L | FTFSSYGMH | 270 | SAISGSGGSTYYA | 966 | CARRLQAVHWF DPW | 1662 | hFzd4L |
| 038S-F12 | hFzd4L | YTFTSYYMH | 271 | GWINTKTGAANYA | 967 | CARDSSLDYW | 1663 | hFzd4L |
| 038S-B07 | hFzd4L | YTFTGYYVH | 272 | GRINPNSGATNYA | 968 | CATGWTANTYD YW | 1664 | hFzd4L |
| 039S-B04 | hFzd4L | FTFSNHYMS | 273 | SSISGRSSFIYYA | 969 | CARVHGGNSLF YFQHW | 1665 | hFzd4L |
| 039S-C02 | hFzd4L | FTFSNHYMS | 274 | SAVDGAGTNTYYA | 970 | CARGGGSYW | 1666 | hFzd4L |
| 039S-H05 | hFzd4L | YTFTNYYMH | 275 | GWMNPSNGDTGYA | 971 | CARDGSLDLW | 1667 | hFzd4L |
| 039S-G01 | hFzd4L | YTFTAYYMH | 276 | GVINPSGGRTTYA | 972 | CARSSGGYSYG QIDYW | 1668 | HFzd4L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 039S-E03 | hFzd4L | YTFTSYYMH | 277 | GWMNPNSGDTGYA | 973 | CARDGSLDYW | 1669 | hFzd4L |
| 039S-C01 | hFzd4L | YTFTGYYMH | 278 | GWMNPNSGNTGYA | 974 | CARDGSGDYW | 1670 | hFzd4L |
| 039S-F02 | hFzd4L | YTFTGYYMH | 279 | GVINPSGGSTTYA | 975 | CARGYWGGYFDLW | 1671 | hFzd4L |
| 039S-E04 | hFzd4L | YTFTGYYMH | 280 | GWMNPNSGNTGYA | 976 | CARDGSMDVW | 1672 | hFzd4L |
| 039S-C05 | hFzd4L | YTFTSYGIS | 281 | GWINPKSGGTRYA | 977 | CARGPSQNYYGMDVW | 1673 | hFzd4L |
| 039S-F06 | hFzd4L | FTFSNHYMS | 282 | SAISGTGRYTYYA | 978 | CARDRRYSSGQNYYYYMDVW | 1674 | hFzd4L |
| 039S-A07 | hFzd4L | YTFTSYYMH | 283 | GWINPNSGGAHYA | 979 | CARGGNWFDPW | 1675 | hFzd4L |
| 039S-E10 | hFzd4L | YTFTSYYMH | 284 | GWMNPNSGNTGYA | 980 | CARDGSFDYW | 1676 | hFzd4L |
| 039S-G07 | hFzd4L | FTFSSYGMH | 285 | SGISGSGGRTYYA | 981 | CARRHPIGAFDIW | 1677 | hFzd4L |
| 039S-A10 | hFzd4L | YTFTNYYMH | 286 | GWMNPKSGNTGYA | 982 | CARDGALDYW | 1678 | hFzd4L |
| 039S-B07 | hFzd4L | YTFTGYYMH | 287 | GWMNPNSANTGYA | 983 | CARDGSLDYW | 1679 | hFzd4L |
| 039S-B09 | hFzd4L | YTFTTYYMH | 288 | GWMNPNTGNTGYA | 984 | CARDGAMDVW | 1680 | hFzd4L |
| 039S-AG8 | hFzd4L | YTFTSYYMH | 289 | GRIIPNTGDTNYA | 985 | CATLPRGRGNYW | 1681 | hFzd4L |
| 039S-C09 | hFzd4L | YTFTGYYMH | 290 | GWINPNSGNTGYA | 986 | CARDGSIDLW | 1682 | hFzd4L |
| 039S-E07 | hFzd4L | YTFTGYYMH | 291 | GVIIPSGGSTLYA | 987 | CARGGYSNYGMDVW | 1683 | hFzd4L |
| 039S-H09 | hFzd4L | YTFTSYYMH | 292 | GVINPSGGATRFA | 988 | CARDGSMDVW | 1684 | hFzd4L |
| 040S-B01 | hFzd4L | YTFTGYYMH | 293 | GWMNPHNGDTGYA | 989 | CARDGSFDYW | 1685 | hFzd4L |
| 040S-A02 | hFzd4L | FTFSSYAMH | 294 | SGIRGSGGATYYA | 990 | CARDGDYVSGYGMDVW | 1686 | hFzd4L |
| 040S-H04 | hFzd4L | FTFSSYAMH | 295 | AVISYDGSNKYYA | 991 | CAKIGTW | 1687 | hFzd4L |
| 040S-E05 | hFzd4L | YTFTGYYMH | 296 | GWINSNSGGTNYA | 992 | CARDGSLDFW | 1688 | hFzd4L |
| 039S-H10 | hFzd4L | YTFTTYYIH | 297 | GWMNPNTGYTGYA | 993 | CARDGSLDYW | 1689 | hFzd4L |
| 040S-B02 | hFzd4L | YTFTGYYVH | 298 | GRINPNSGATNYA | 994 | CATGWTANTDYW | 1690 | hFzd4L |
| 040S-C02 | hFzd4L | YTFTNYYMH | 299 | GWMNPNSGNTGYA | 995 | CARDGALDYW | 1691 | hFzd4L |
| 040S-A05 | hFzd4L | YTFTGYYVH | 300 | GWVZAFNGDTNYA | 996 | CARDGSMDVW | 1692 | hFzd4L |
| 039S-C12 | hFzd4L | YTFTGYYMH | 301 | GWMNPNSGNTGYA | 997 | CARDGSMDVW | 1693 | hFzd4L |
| 039S-F12 | hFzd4L | YTFTSYYMH | 302 | GRIIPNTGDTNYA | 998 | CATLPRGRGNYW | 1694 | hFzd4L |
| 040S-E01 | hFzd4L | YTFTSYYMH | 303 | GWMNPNSGNTGYA | 999 | CARDGSFDYW | 1695 | hFzd4L |
| 040S-E02 | hFzd4L | YTFTSYYMH | 304 | GWMNPSSGNTGYA | 1000 | CARDGSLDLW | 1696 | hFzd4L |
| 039S-F11 | hFzd4L | YTFTSYYMH | 305 | GWMNPNSGNTGYA | 1001 | CARDGSMDVW | 1697 | hFzd4L |
| 040S-F01 | hFzd4L | YTFTGYYMH | 306 | GWMNPHSANTGFA | 1002 | CARDGSMDVW | 1698 | hFzd4L |
| 040S-F02 | hFzd4L | YTFTGYYMH | 307 | GWINPNSGNTGFA | 1003 | CAREGRHDFWSGYFFDYW | 1699 | hFzd4L |

TABLE 2-continued

Clone IDs and CDR sequences for hinge specific ("L") or hinge (L) + CRD ("ext") binders. "CDRH" indicates heavy chain CDRs, and "CDRL" indicates light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 040S-E04 | hFzd4L | YTFTGYYVH | 308 | GWVSAFNGDTNYA | 1004 | CARDGSMDVW | 1700 | hFzd4L |
| 040S-D05 | hFzd4L | GTFSSYAIS | 309 | GRIIPILGIANYA | 1005 | CARAVGSSSSN YYYYYGMDVW | 1701 | hFzd4L |
| 039S-G11 | hFzd4L | YTFTGYYMH | 310 | GMIIPRHGGTAYA | 1006 | CARVPRGGENY W | 1702 | hFzd4L |
| 040S-G01 | hFzd4L | FTFSSYAMH | 311 | AVISYDGSNKYXA | 1007 | CARGRKRSSGW HFDYW | 1703 | hFzd4L |
| 036S-C01 | hFzdSL | YTFTGHYIH | 312 | GIINZSSGSTTYA | 1008 | CAREGYSYYGM DVW | 1704 | hFzd5L hFzdSL, |
| 036S-F01 | hFzdSL | FTFSNHYTS | 313 | STIGTGGGTYYA | 1009 | CGKSYPYYYHC IDVW | 1705 | mFzdSL |
| 036S-B02 | hFzdSL | YTFSAYYMN | 314 | GIIDAGGRTSNA | 1010 | CARDLGYGFDY W | 1706 | hFzd5L |
| 036S-D02 | hFzdSL | FSVSSNYMT | 315 | SSIGVNGDTYYL | 1011 | CARHKDGGDMG YW | 1707 | hFzd5L |
| 036S-F02 | hFzd5L | GTFSSYAIS | 316 | GIINPSGGSTZYA | 1012 | CASYDYYYYYG MDVW | 1708 | hFzd5L |
| 036S-G02 | hFzdSL | GTFZZYZIZ | 317 | EZINPSGGSTSYA | 1013 | CASYDYYYYYG MDVW | 1709 | hFzd5L |
| 036S-H02 | hFzd5L | FTFSNHYTS | 318 | STIGTGGGTYYA | 1014 | CAKSDPYYYHG IDVW | 1710 | hFzdSL |
| 036S-A03 | hFzd5L | FSVSSNYMT | 319 | SSIGVNGDTYYL | 1015 | CARHKDGGDMG YW | 1711 | hFzdSL |
| 036S-C03 | hFzdSL | YTFASYDIN | 320 | GIINPSGGSTSYA | 1016 | CARYSSSVYYG MDVW | 1712 | hFzd5L |
| 036S-C04 | hFzd5L | YTFTGYYMH | 321 | GIINPRDGDTVYA | 1017 | CARDGVAAAAA YYMDVW | 1713 | hFzd5L |
| 036S-D04 | hFzdSL | YTFTGHYIH | 322 | GIINPSSGSTTYA | 1018 | CAREGYSYYGM DVW | 1714 | hFzd5L |
| 036S-E04 | hFzd5L | GTFSSYAIS | 323 | GIINPSGGSTSYA | 1019 | CASYDYYYYYG MDVW | 1715 | hFzd5L hFzd5L, |
| 036S-A05 | hFzdSL | YTFTSYFMH | 324 | GIINZSGGSTSYA | 1020 | CARDYGDYELG DNYYYYGMDVW | 1716 | mFzdSL |
| 036S-B05 | hFzdSL | YTFTSYYMH | 325 | GIINPSGGSTSYA | 1021 | CARSIAGMDVW | 1717 | hFzdSL |
| 036S-C05 | hFzdSL | FSVSSZYMT | 326 | SSIGVNGDTYYL | 1022 | CARHKDGGDMG YW | 1718 | hFzdSL |
| 036S-D05 | hFzd5L | GTFSSYAVS | 327 | GWIIPFSGTVNYA | 1023 | CARFDGYYYYG MDVW | 1719 | hFzd5L |
| 036S-D01-3 | hFzdSL | FTFSSYAMS | 328 | SSISSSGSYIDYA | 1024 | CAKDRFAKDYG YFQHW | 1720 | hFzd5L |
| 036S-D02-5 | hFzd5L | FTFDDYAMH | 329 | SGINWNGGSTGYA | 1025 | CARDSRSGDYF DYW | 1721 | hFzdSL |
| 036S-G03-3 | hFzdSL | GTFSSYAIS | 330 | GWINPNNGGTDYA | 1026 | CARDIVWFGGY YYYGMDVW | 1722 | hFzdSL |
| 040S-D07 | hFzd6L | YTFTSYYMH | 331 | GWINPNSGGTNYA | 1027 | CARDSGHW | 1723 | hFzd6L, mFzd6L |
| 040S-E08 | hFzd6L | YTFTSYYIH | 332 | GWINPSSGDTKYA | 1028 | CAKTGVW | 1724 | hFzd6L, mFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 040S-B09 | hFzd6L | FSFTSHGMH | 333 | SAISGSGGSTYYA | 1029 | CARGVSRRAFD IW | 1725 | hFzd6L, mFzd6L |
| 040S-H09 | hFzd6L | YIFTGYYMH | 334 | GIIDPSGGSTSYA | 1030 | CARRGFDPW | 1726 | hFzd6L, mFzd6L |
| 040S-E10 | hFzd6L | GTFSGYAIS | 335 | GWMNPSRGNTVYA | 1031 | CARQGVGAKYG MDVW | 1727 | hFzd6L, mFzd6L |
| 040S-D11 | hFzd6L | GTFSDYYIH | 336 | GMINPIFGTAKYA | 1032 | CARSTNW | 1728 | hFzd6L, mFzd6L |
| 041S-B01 | hFzd6L | FTFSSYAMH | 337 | SSISSSSYIYYA | 1033 | CARTGTTYRSF DYW | 1729 | hFzd6L, mFzd6L |
| 040S-E07 | hFzd6L | FTFRTHAMH | 338 | AVISKDGSQRYYA | 1034 | CASSSSSLRSH DYW | 1730 | hFzd6L, mFzd6L |
| 040S-B08 | hFzd6L | YTFTTYSIH | 339 | GWMNPNTGNTGYA | 1035 | CARLPGGAVAG FDYW | 1731 | hFzd6L, mFzd6L |
| 040S-F08 | hFzd6L | YTFTGYYMH | 340 | GIINPSAGSTNYA | 1036 | CARDAVSRGRF DYW | 1732 | hFzd6L, mFzd6L |
| 040S-B12 | hFzd6L | YTFTGYSLH | 341 | GRINPNSGGTDYA | 1037 | CATRMDVW | 1733 | hFzd6L, mFzd6L |
| 040S-H06 | hFzd6L | YTFSNYYIH | 342 | GIINPSGGSTSYA | 1038 | CARTDALSWRG VPFDYW | 1734 | hFzd6L, mFzd6L |
| 040S-F07 | hFzd6L | FTFSDYYMS | 343 | SHIKSDGSSTRYA | 1039 | CARVKVPAAGL NYWFDPW | 1735 | hFzd6L, mFzd6L |
| 040S-G08 | hFzd6L | GTFSSYAIS | 344 | GIINPSGGSTSYA | 1040 | CARSDYYYYM DVW | 1736 | hFzd6L, mFzd6L |
| 040S-B10 | hFzd6L | GTFSNYAYS | 345 | GWMNPSSGNTGYA | 1041 | CARWTRDSSGY IDYW | 1737 | hFzd6L, mFzd6L |
| 040S-G10 | hFzd6L | DTFTRHYVH | 346 | GRINPNSGGTNYA | 1042 | CASQDIW | 1738 | hFzd6L, mFzd6L |
| 040S-C12 | hFzd6L | YTFTNYYMH | 347 | GWINPNSGGTKFA | 1043 | CARDKGNW | 1739 | hFzd6L, mFzd6L |
| 040S-A07 | hFzd6L | YTFASYYIH | 348 | GWISAYNGNTQHA | 1044 | CARGRKAFDIW | 1740 | hFzd6L, mFzd6L |
| 040S-G07 | hFzd6L | FTFSSYAMH | 349 | SAISGTGDNTYYA | 1045 | CARSAAGTRAF DYW | 1741 | hFzd6L, mFzd6L |
| 040S-C10 | hFzd6L | YTFNNYYMH | 350 | AIINPNGGATSYA | 1046 | CARDSGDYYFD YW | 1742 | hFzd6L, mFzd6L |
| 040S-F12 | hFzd6L | YTFTGYYMH | 351 | GRMNPNSGNTVYA | 1047 | CARGGYGOEGP W | 1743 | hFzd6L, mFzd6L |
| 040S-E11 | hFzd6L | FTFGDYAMS | 352 | TGISYDASKEYYA | 1048 | CAKYSSSWYYF DYW | 1744 | hFzd6L, mFzd6L |
| 040S-G12 | hFzd6L | YTFTGYYMH | 353 | GIINPTSGKTSYA | 1049 | CARRGFDYW | 1745 | hFzd6t, mFzd6L |
| 041S-D01 | hFzd6L | HTFSSYVLG | 354 | GWINPNSGGTNYA | 1050 | CARGTRRMFDY W | 1746 | hFzd6L, mFzd6L |
| 040S-H07 | hFzd6L | YTITTYYMH | 355 | GIIDPNSGRTSYA | 1051 | CARNNYYDSSG PKGIDYW | 1747 | hFzd6L, mFzd6L |
| 040S-C08 | hFzd6L | FTFSSYAMH | 356 | SAISTSGDSTYYA | 1052 | CARSIIRRYFD LW | 1748 | hFzd6L, mFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|----------|---------|-------|--------------|-------|--------------|-------|--------------|-------------------|
| 040S-H08 | hFzd6L | FTFSSYAMH | 357 | SAISGSGGSTYYA | 1053 | CASSSSLVRAF DIW | 1749 | hFzd6L, mFzd6L |
| 040S-C09 | hFzd6L | YTFTGNYMH | 358 | GWMNPSSGNTGYA | 1054 | CARVGRDYYYG MDVW | 1750 | hFzd6L, mFzd6L |
| 040S-H10 | hFzd6L | YTFTRYYMH | 359 | GWMDPYSGNTGYA | 1055 | CARPGYSSGWA FDYW | 1751 | hFzd6L, mFzd6L |
| 040S-F11 | hFzd6L | YTFTNYYVH | 360 | GWMNPNSGNTGYA | 1056 | CAKGIAAAGTW SGYYGMDVW | 1752 | hFzd6L, mFzd6L |
| 041S-A01 | hFzd6L | YTFTNHGIS | 361 | GGINPNSGGTNYA | 1057 | CARHQRAAAGR KGFDYW | 1753 | hFzd6L, mFzd6L |
| 041S-E01 | hFzd6L | GAFSSYAIS | 362 | GIINPNSGDTGYA | 1058 | CARHALSSTGY MDVW | 1754 | hFzd6L, mFzd6L |
| 040S-B07 | hFzd6L | YTFTRYYLH | 363 | GIINPSGGSTTYA | 1059 | CARGGRYAFDI W | 1755 | hFzd6L, mFzd6L |
| 040S-D08 | hFzd6L | FTVSRNYMD | 364 | ATISGTGGSIYYA | 1060 | CARPRTVTRRG WYFDLW | 1756 | hFzd6L, mFzd6L |
| 040S-D09 | hFzd6L | YTFTSYYMH | 365 | GWISADNGNTNYA | 1061 | CARDRYYW | 1757 | hFzd6L, mFzd6L |
| 040S-F09 | hFzd6L | FAFSSYALH | 366 | SVISGSGGTTYYA | 1062 | CAREFRATGKS MDVW | 1758 | hFzd6L, mFzd6L |
| 040S-D10 | hFzd6L | YSFSSYYMH | 367 | GWINPNSGGTNYA | 1063 | CARDKTAW | 1759 | hFzd6L, mFzd6L |
| 040S All | hFzd6L | YTFTSYYMH | 368 | GGTIPIYGTTNYA | 1064 | CARGRNYGDYD DYW | 1760 | hFzd6L, mFzd6L |
| 040S-D12 | hFzd6L | FTFHNSAMH | 369 | SAIGTGGGTYYA | 1065 | CTTRPWGSDYW | 1761 | hFzd6L, mFzd6L |
| 041S-F01 | hFzd6L | FTFSSHGMH | 370 | SAMNFNTGSTYYA | 1066 | CANDRLGYW | 1762 | hFzd6L, mFzd6L |
| 040S-B11 | hFzd6L | YTFTSYDIN | 371 | GMINPDVGSTSYA | 1067 | CARGQWLAYGM DVW | 1763 | hFzd6L, mFzd6L |
| 040S-G11 | hFzd6L | FTFSSYAMS | 372 | SAISGSGGSTYYA | 1068 | CARHYRYSGGG AFDIW | 1764 | hFzd6L, mFzd6L |
| 040S-C07 | hFzd6L | GTFSSYAIS | 373 | GIINPSGGRTSYA | 1069 | CASSDKIRSLD VW | 1765 | hFzd6L, mFzd6L |
| 040S-A08 | hFzd6L | YTFTGYYVH | 374 | GWISAYNGNTNYA | 1070 | CARVSPYSGWG FDYW | 1766 | hFzd6L, mFzd6L |
| 040S-A09 | hFzd6L | DTFTSYYMH | 375 | GWMNPNSGNTGYA | 1071 | CARYSGSYPQN WYFDLW | 1767 | hFzd6L, mFzd6L |
| 040S-C11 | hFzd6L | GTFSGYAIS | 376 | GWINPNSGGTNYA | 1072 | CARAGRYYYYG MDVW | 1768 | hFzd6L, mFzd6L |
| 040S-H11 | hFzd6L | YTFTNYYMH | 377 | GWINPKSGGTHFA | 1073 | CARTQFAGYFD LW | 1769 | hFzd6L, mFzd6L |
| 041S-D02 | hFzd6L | YTFTSNYIH | 378 | GRITPSDGTTTYA | 1074 | CARGGYGDSGY W | 1770 | hFzd6L, mFzd6L |
| 041S-A04 | hFzd6L | FTFSGYYMH | 379 | GIINPSGGSTSYA | 1075 | CARGDRYYYYM DVW | 1771 | hFzd6L, mFzd6L |
| 041S-A08 | hFzd6L | FTFSSSAMH | 380 | SAIGIGGGTYYA | 1076 | CAKSTDYSKAF DYW | 1772 | hFzd6L, mFzd6L |

TABLE 2-continued

Clone IDs and CDR sequences for hinge specific ("L") or hinge (L) + CRD ("ext") binders. "CDRH" indicates heavy chain CDRs, and "CDRL" indicates light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 041S-F08 | hFzd6L | YTFTSYYMH | 381 | GWMNPNSGNTGYA | 1077 | CARGRYAFDVW | 1773 | hFzd6L, mFzd6L |
| 041S-H01 | hFzd6L | FTFSSYAMH | 382 | SAISGSAAGTYYA | 1078 | CARSGPGYRAF DIW | 1774 | hFzd6L, mFzd6L |
| 041S-E02 | hFzd6L | YTFTDYYMH | 383 | GIINPSGGSTSYA | 1079 | CARDGGDYYFD YW | 1775 | hFzd6L, mFzd6L |
| 041S-C03 | hFzd6L | FTFSSHSTH | 384 | SGLSASGANTYYA | 1080 | CARSTPRVFDL W | 1776 | hFzd6L, mFzd6L |
| 041S-F06 | hFzd6L | GTFSNQAIS | 385 | GWMNPHSGNTGLA | 1081 | CARVTPYCGGD CYSDDYW | 1777 | hFzd6L, mFzd6L |
| 041S-F07 | hFzd6L | YTFZAZHMH | 386 | GIINPSGGSTSYA | 1082 | CARRGFDYW | 1778 | hFzd6L, mFzd6L |
| 041S-G08 | hFzd6L | FSFSSYGMT | 387 | SAIGTGGGTYYA | 1083 | CARAARSRYYM DVW | 1779 | hFzd6t, mFzd6L |
| 041S-F02 | hFzd6L | FTFSSYAMH | 388 | AVISKDESNKYYA | 1084 | CAKSSSSRRAF DYW | 1780 | hFzd6L, mFzd6L |
| 041S-D03 | hFzd6L | YTFTGYYMH | 389 | GWMNPNSGNTGYA | 1085 | CARVYRGSYYG MDVW | 1781 | hFzd6L, mFzd6L |
| 041S-C05 | hFzd6L | YTFTSYYVH | 390 | GIINPSGGATSYA | 1086 | CARTDYYYYYM DVW | 1782 | hFzd6L, mFzd6L |
| 041S-G06 | hFzd6L | YTFTSYYMH | 391 | GIIDPNSGRTGYA | 1087 | CARDSRLAREF DYW | 1783 | hFzd6L, mFzd6L |
| 041S-C08 | hFzd6L | YTFTNYYIH | 392 | GWINPNSGGTNYA | 1088 | CASGGRHW | 1784 | hFzd6L, mFzd6L |
| 041S-H08 | hFzd6L | YTFNNYYMH | 393 | AIINPNGGATSYA | 1089 | CARDSGDYYFD YW | 1785 | hFzd6L, mFzd6L |
| 041S-E09 | hFzd6L | FTFSSYAMH | 394 | STISXNSRSIDYA | 1090 | CARTYPAIRAF DIW | 1786 | hFzd6L, mFzd6L |
| 041S-G02 | hFzd6L | YTFTGYYMH | 395 | GRINPSGGRTTYA | 1091 | CARGGPSGDYW | 1787 | hFzd6L, mFzd6L |
| 041S-C04 | hFzd6L | DSFTNYYMH | 396 | GRINPNSGGTNYA | 1092 | CARGGADFDYW | 1788 | hFzd6L, mFzd6L |
| 041S-D05 | hFzd6L | YTFASYYVH | 397 | GRINPINGGTNYA | 1093 | CARGSYYGDYG PW | 1789 | hFzd6L, mFzd6L |
| 041S-A06 | hFzd6L | YTFTSYGIS | 398 | GWINPNSGGTNYA | 1094 | CARFYDAFDIW | 1790 | hFzd6L, mFzd6L |
| 041S-H06 | hFzd6L | FTFSSYAMH | 399 | SAISGSGGSTYYA | 1095 | CARSTIWGRAF DIW | 1791 | hFzd6L, mFzd6L |
| 041S-F09 | hFzd6L | YTFTSYYMH | 400 | GIINPSGGSTSYA | 1096 | CARDGQGAGGY YYYGMDVW | 1792 | hFzd6L, mFzd6L |
| 041S-B02 | hFzd6L | YTFTSYYMH | 401 | GIINPSGGSTTYA | 1097 | CARGGRIW | 1793 | hFzd6L, mFzd6L |
| 041S-H02 | hFzd6L | FIFSSYAMS | 402 | SGISGSSASTYYA | 1098 | CARGRRAARTF DYW | 1794 | hFzd6L, mFzd6L |
| 041S-F03 | hFzd6L | FRFSNYAMT | 403 | SGVDGSGGKTYYA | 1099 | CAKVIRSGRNF DYW | 1795 | hFzd6L, mFzd6L |
| 041S-D04 | hFzd6L | YTFTGYYLH | 404 | GWMSPKNGDTRFA | 1100 | CARVGYGMDVW | 1796 | hFzd6L, mFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 041S-G04 | hFzd6L | FTFSSYAMH | 405 | SAISGSGGSTYYA | 1101 | CARVGSGWSRA FDYW | 1797 | hFzd6L, mFzd6L |
| 041S-E05 | hFzd6L | YTFTGYYMH | 406 | GIINPSGGSTSYA | 1102 | CARDNQDYYFD YW | 1798 | hFzd6L, mFzd6L |
| 041S-A07 | hFzd6L | ISVGSNYMS | 407 | SAISFGGSTYYA | 1103 | CARDRVEQLDG AKRYYYGMDV W | 1799 | hFzd6L, mFzd6L |
| 041S-H07 | hFzd6L | FTFSTYAMH | 408 | SAISASGGRTYYA | 1104 | CAKAIRGGIDY W | 1800 | hFzd6L, mFzd6L |
| 041S-D05 | hFzd6L | FAFSGSAMH | 409 | SGISGSGGSTFYA | 1105 | CARTRVAYFDY W | 1801 | hFzd6L, mFzd6L |
| 041S-A09 | hFzd6L | YTFTRHYVH | 410 | GVINPSGGSANYA | 1106 | CARDLRKAGTR WFDPW | 1802 | hFzd6L, mFzd6L |
| 041S-G03 | hFzd6L | FTFSGSALH | 411 | SAISGSGGSTYYA | 1107 | CALRGVW | 1803 | hFzd6L, mFzd6L |
| 041S-E04 | hFzd6L | NTFIGYNMH | 412 | GGIIPLFGTTNYA | 1108 | CAKEATGTGAF QHW | 1804 | hFzd6L, mFzd6L |
| 041S-H04 | hFzd6L | YTFTNYYIH | 413 | GWMNPNSGNTGYA | 1109 | CARSGSSRYYY GMDVW | 1805 | hFzd6L, mFzd6L |
| 041S-F05 | hFzd6L | FTFSSYAMH | 414 | SAIGAGGGTYYA | 1110 | CANSLPAPHAF DIW | 1806 | hFzd6L, mFzd6L |
| 041S-C06 | hFzd6L | YTFTRHYVH | 415 | GIINPSGGSATYA | 1111 | CARDSGTRRWH GMDVW | 1807 | hFzd6L, mFzd6L |
| 041S-B07 | hFzd6L | YTFTSYGIS | 416 | GWINPNSGDTKYS | 1112 | CARGLGGETW | 1808 | hFzd6L, mFzd6L |
| 041S-B09 | hFzd6L | YAFTGYYMH | 417 | GWINPNNGGTNYA | 1113 | CARDRNYW | 1809 | hFzd6L, mFzd6L |
| 041S-H09 | hFzd6L | YTFTSYYMH | 418 | GIINPNSGGTNYA | 1114 | CARESIAAPVR SYNWFDPW | 1810 | hFzd6L, mFzd6L |
| 041S-AG3 | hFzd6L | YRFTGYYMH | 419 | GIINPSGGSTSYA | 1115 | CARDRKARGAL WYW | 1811 | hFzd6L, mFzd6L |
| 041S-A05 | hFzd6L | YTFTGYYMH | 420 | GIINPNGGSANYA | 1116 | CARDRRAIYGM DVW | 1812 | hFzd6L, mFzd6L |
| 041S-G05 | hFzd6L | FTFSSYAMH | 421 | SYSSGNSGYTNYA | 1117 | CARSYSSGRAF DYW | 1813 | hFzd6L, mFzd6L |
| 041S-D06 | hFzd6L | FTFTNYYVH | 422 | GIINPSAGRTRYA | 1118 | CATAKVKHPRD DAFDIW | 1814 | hFzd6L, mFzd6L |
| 041S-C07 | hFzd6L | GRFSTYALS | 423 | GAIDPSGGSTNYA | 1119 | CARVLAVAGQY YFDYW | 1815 | hFzd6L, mFzd6L |
| 041S-E08 | hFzd6L | FSFSNYAMG | 424 | SAISSGSAYTYYA | 1120 | CARHKRTVTAF MDVW | 1816 | hFzd6L, mFzd6L |
| 041S-C09 | hFzd6L | FTFSSYAMH | 425 | AVISYDGSNKYYA | 1121 | CARDDIYSSSS VDYYYYGMDVW | 1817 | hFzd6L, mFzd6L |
| 041S-A10 | hFzd6L | FTFSSYAMH | 426 | AVISYDGSNKYYA | 1122 | CARDDIYSSSS VDYYYYGMDVW | 1818 | hFzd6L, mFzd6L |
| 041S-C02 | hFzd6L | YTFTDYYIH | 427 | GIINPSGGSTSYA | 1123 | CARHVGSVAHT YQNWFDPW | 1819 | hFzd6L, mFzd6L |
| 041S-B03 | hFzd6L | FTFSSYAMH | 428 | ZVISYDGSNKYYA | 1124 | CARDDIYSSSS VDYYYYGMDVW | 1820 | hFzd6L, mFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 041S-F04 | hFzd6L | YTFTGYHIH | 429 | GRITPIFGSADYA | 1125 | CARGFGYGDYS TYW | 1821 | hFzd6L, mFzd6L |
| 041S-B05 | hFzd6L | GTFSNYAIN | 430 | GWMNPNSGNTGYA | 1126 | CARVGYSSGWK DAFDIW | 1822 | hFzd6L, mFzd6L |
| 041S-E06 | hFzd6L | YTFTDYYMH | 431 | GIINPSGGTTSYA | 1127 | CARGGDSYYYY MDVW | 1823 | hFzd6L, mFzd6L |
| 041S-D07 | hFzd6L | YTFTSNNMH | 432 | GMINPSGGSTSYA | 1128 | CARGDYYGSGA GYW | 1824 | hFzd6L, mFzd6L |
| 041S-B10 | hFzd6L | YTFTSYYMH | 433 | GWMNPNSGNTGYA | 1129 | CARVFYDSSGY YYFDYW | 1825 | hFzd6L, mFzd6L |
| 042S-F03 | hFzd6L | ZZFTANYIZ | 434 | GRINHNSGGTNYA | 1130 | CARDQWKPYYF DFW | 1826 | hFzd6L, mFzd6L |
| 041S-C10 | hFzd6L | YTFTSYGIS | 435 | GGITPIFGTAKYA | 1131 | CARAVGRVGAT LDYW | 1827 | hFzd6L, mFzd6L |
| 041S-H10 | hFzd6L | DSVSNNNAA WN | 436 | GRTYQRSKWFTYY A | 1132 | CARGNIVGAID YW | 1828 | hFzd6L, mFzd6L |
| 042S-B02 | hFzd6L | YTFTANYIH | 437 | GRINPNSGGTNYA | 1133 | CARDQWKPYYF DSW | 1829 | hFzd6L, mFzd6L |
| 042S-G03 | hFzd6L | ZSFSSYVMZ | 438 | AVISYDGSNKYYA | 1134 | CARTATCGYYF DYW | 1830 | hFzd6L, mFzd6L |
| 041S-D10 | hFzd6L | FTFSSYZMH | 439 | AZIZYDGSNKZYA | 1135 | CAKEGWLLSYA FDIW | 1831 | hFzd6L, mFzd6L |
| 041S-G11 | hFzd6L | FTFSZYZMH | 440 | AVISYDGSNKYYA | 1136 | CVVRGDYW | 1832 | hFzd6L, mFzd6L |
| 042S-C01 | hFzd6L | FTFSSYAMH | 441 | AVISYDGSNKYYA | 1137 | CAKEGWLLSYA FDIW | 1833 | hFzd6L, mFzd6L |
| 042S-A03 | hFzd6L | FTFRRHAMH | 442 | SRINNDGRITSYA | 1138 | CASLIITENQA FDFW | 1834 | hFzd6L, mFzd6L |
| 041S-B11 | hFzd6L | FTFZRYZLZ | 443 | TVIZZZGSNKZXA | 1139 | CARTYRCGYSL DYW | 1835 | hFzd6L, mFzd6L |
| 042S-A04 | hFzd6L | FTFGDYAMZ | 444 | GFIRSKAYGGTTE YA | 1140 | CTTDSRWFDIW | 1836 | hFzd6L, mFzd6L |
| 041S-C11 | hFzd6L | FTFSSYAMH | 445 | AVISYDGSNKYYA | 1141 | CVVRGDYW | 1837 | hFzd6L, mFzd6L |
| 042S-D03 | hFzd6L | FTFSSYAMH | 446 | AVISYDGSNKZYA | 1142 | CAKEGWLLSYA FDIW | 1838 | hFzd6L, mFzd6L |
| 042S-F04 | hFzd6L | DSVSSSSAA WT | 447 | GRTYYRSKWYNDY A | 1143 | CVRGGYDFDSW | 1839 | hFzd6L, mFzd6L |
| 042S-D01 | hFzd6L | FTFSSYAMH | 448 | AVISYDGSNKYYA | 1144 | CARGGPFGSNW | 1840 | hFzd6L, mFzd6L |
| 042S-H01 | hFzd6L | FTFSSYAMH | 449 | AVISYDGSNKYYA | 1145 | CAKEGWLLSYA FDIW | 1841 | hFzd6L, mFzd6L |
| 042S-C05 | hFzd6L | FTFSSYAMH | 450 | AVISYDGSNKYYA | 1146 | CAKEGWLLSYA FDIW | 1842 | hFzd6L, mFzd6L |
| 041S-E11 | hFzd6L | FTFSZYZMZ | 451 | AVISYDGSNKYYA | 1147 | CVVRGDYW | 1843 | hFzd6L, mFzd6L |
| 041S-B12 | hFzd6L | FTFSSYAMH | 452 | AVISYDGSNKYYA | 1148 | CAKEGWLLSYA FDIW | 1844 | hFzd6L, mFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 041S-G12 | hFzd6L | FTFSSFGMH | 453 | AVISYDGSNKYYA | 1149 | CASTPGFW | 1845 | hFzd6L, mFzd6L |
| 042S-E01 | hFzd6L | DSVSSSSAA WT | 454 | GRTZYRSKWYNDY A | 1150 | CVRGGYDFDSW | 1846 | hFzd6L, mFzd6L |
| 042S-B04 | hFzd6L | FTFSTYDMH | 455 | AVISYDGSNKYYA | 1151 | CATRGRYFDYW | 1847 | hFzd6L, mFzd6L |
| 041S-G10 | hFzd6L | FTFSSYZMH | 456 | AZISYDGSNKZYA | 1152 | CASSPGYW | 1848 | hFzd6L, mFzd6L |
| 042S-A02 | hFzd6L | FTFSSYAMH | 457 | AVISYDGSNKYYA | 1153 | CAKEGWLLSYA FDIW | 1849 | hFzd6L, mFzd6L |
| 042S-C03 | hFzd6L | FTFSSYAMH | 458 | AVISYDGSNKYYA | 1154 | CVVRGDYW | 1850 | hFzd6L, mFzd6L |
| 042S-C04 | hFzd6L | FTFSSYAMH | 459 | AVISYDGSNKYYA | 1155 | CARTDTSGYYF DYW | 1851 | hFzd6L, mFzd6L |
| 042S-H07 | hFzd6L | FTFSSYAMH | 460 | AVISYDGSNKYYA | 1156 | CARGSTYYFDY W | 1852 | hFzd6L, mFzd6L |
| 042S-G08 | hFzd6L | FTFSSYAMS | 461 | SAISGSGGSTYYA | 1157 | CARAWRADAFD IW | 1853 | hFzd6L, mFzd6L |
| 042S-H09 | hFzd6L | FTFSSYAMH | 462 | AVISYDGSNKYYA | 1158 | CARGGKDW | 1854 | hFzd6L, mFzd6L |
| 042S-D10 | hFzd6L | YTFTSYYMH | 463 | GIINPSGGSTSYA | 1159 | CALRVPVITFG GVIGDDAFDIW | 1855 | hFzd6L, mFzd6L |
| 042S-G10 | hFzd6L | FTFSSYAMH | 464 | AVISYDGSNKYYA | 1160 | CARGGKDW | 1856 | hFzd6L, mFzd6L |
| 042S-A08 | hFzd6L | GSISSSSYY WG | 465 | GSIYYSGSTYYN | 1161 | CARYGHSSGWS FDYW | 1857 | hFzd6L, mFzd6L |
| 042S-H08 | hFzd6L | FTFSSYGMH | 466 | AVISYDGSNKYYA | 1162 | CATGGPIDYW | 1858 | hFzd6L, mFzd6L |
| 042S-E09 | hFzd6L | FTFSSYAMH | 467 | AVISYDGSNKYYA | 1163 | CASQSRGW | 1859 | hFzd6L, mFzd6L |
| 042S-A06 | hFzd6L | FTFSSYAMH | 468 | AVISYDGSNKYYA | 1164 | CVVRGDYW | 1860 | hFzd6L, mFzd6L |
| 042S-F06 | hFzd6L | FTFSZZZMH | 469 | YHHMZEADZZYA | 1165 | CARGGAGEW | 1861 | hFzd6L, mFzd6L |
| 042S-B08 | hFzd6L | FTFSSYAMH | 470 | AVISYDGSNKYYA | 1166 | CARTATSGYYF DYW | 1862 | hFzd6L, mFzd6L |
| 042S-A09 | hFzd6L | FTFSSYGMH | 471 | AVISYDGSNKYYA | 1167 | CATGGPIDYW | 1863 | hFzd6L, mFzd6L |
| 042S-H10 | hFzd6L | FTFSSYAMS | 472 | SGISGSGGNTYYA | 1168 | CATAGVGAVAG TIHLDAFDIW | 1864 | hFzd6L, mFzd6L |
| 042S-D07 | hFzd6L | FTFSSYZZH | 473 | AVISYZZSNKZYA | 1169 | CARTDTCGYYF DYW | 1865 | hFzd6L, mFzd6L |
| 042S-B09 | hFzd6L | FTFSSYZMH | 474 | AVISYDGSNKYYA | 1170 | CARGGKDW | 1866 | hFzd6L, mFzd6L |
| 042S=A11 | hFzd6L | FTFSSYAMT | 475 | ANIKTDGSEKYYV | 1171 | CAGGGALDYW | 1867 | hFzd6L, mFzd6L |
| 042S-H06 | hFzd6L | FTFSSYAMH | 476 | AVISYDGSNKYYA | 1172 | CVVRGDYW | 1868 | hFzd6L, mFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 042S-E07 | hFzd6L | FTFSSYAMH | 477 | AVISYDGSNKYYA | 1173 | CVVRGDYW | 1869 | hFzd6L, mFzd6L |
| 042S-D08 | hFzd6L | FTFSSYAMH | 478 | AVISYDGSNKYYA | 1174 | CANPTYGMDVW | 1870 | hFzd6L, mFzd6L |
| 042S-F09 | hFzd6L | FTFSSYGMH | 479 | SAISGSGGSTYYA | 1175 | CARDQGGATDY W | 1871 | hFzd6L, mFzd6L |
| 042S-A10 | hFzd6L | FTFIZYAMS | 480 | SGISGSSGNTYYA | 1176 | CAKGYSGSYSL YFDYW | 1872 | hFzd6L, mFzd6L |
| 042S-C09 | hFzd6L | FTFSSYAMS | 481 | SAISGSGGSTYYA | 1177 | CAKATANDAFD IW | 1873 | hFzd6L, mFzd6L |
| 042S-F10 | hFzd6L | FTFGGYAMS | 482 | GFIRSKTYGGTTE YA | 1178 | CSRGGSYAFDY W | 1874 | hFzd6L, mFzd6L |
| 042S-D11 | hFzd6L | FIFSZYAMS | 483 | SGISGSGDSTZYA | 1179 | CAKSSGGGFDL W | 1875 | hFzd6L, mFzd6L |
| 042S-F07 | hFzd6L | FTFSSYAMS | 484 | SAISGSGGSTYYA | 1180 | CAKVTVGASRS FDYW | 1876 | hFzd6L, mFzd6L |
| 042S-E08 | hFzd6L | FTFSSYAMH | 485 | SAISSNGGSTZYA | 1181 | CAKSTGSLYRA FDYW | 1877 | hFzd6L, mFzd6L |
| 042S-B10 | hFzd6L | FTFSSYAMS | 486 | SAISGSGGSTYYA | 1182 | CAKDSYYGSGS DDAFDIW | 1878 | hFzd6L, mFzd6L |
| 042S-B11 | hFzd6L | FTFSSYGMH | 487 | AVISYDGSNKYYA | 1183 | CATGGPIDYW | 1879 | hFzd6L, mFzd6L |
| 042S-F11 | hFzd6L | FTFSZYGMH | 488 | AVISZDGSNKZYA | 1184 | CAKVAPGLGSG ARGYGMDVW | 1880 | hFzd6L, mFzd6L |
| 042S-B07 | hFzd6L | FTFSSYZMH | 489 | AVISYDGSNKXYA | 1185 | CVVRGDYW | 1881 | hFzd6L, mFzd6L |
| 042S-G07 | hFzd6L | GTFSSYAIS | 490 | GGIIPIFGTANYA | 1186 | CARGLFGWIDP AW | 1882 | hFzd6L, mFzd6L |
| 042S-F08 | hFzd6L | NTFTNYGIH | 491 | GWINAGNGNTKYS | 1187 | CLRRAYSDYEV RGEEPW | 1883 | hFzd6L, mFzd6L |
| 042S-C10 | hFzd6L | FTFSSYGMH | 492 | AVISYDGSNKYYA | 1188 | CATGGPIDYW | 1884 | hFzd6L, mFzd6L |
| 043S-D05 | hFzd6L | FTFSZZZMH | 493 | AZISYDGSNKZYA | 1189 | CARGGPYSSGW IDYW | 1885 | hFzd6L, mFzd6L |
| 043S-H04 | hFzd6L | FTFSGYAMH | 494 | AVISYDGSNKYYA | 1190 | CARGPNYYDSS ADYW | 1886 | hFzd6L, mFzd6L |
| 043S-G08 | hFzd6L | FTFSGYAMH | 495 | AVISYDGSNKYYA | 1191 | CARGPNYYDSS ADYW | 1887 | hFzd6L, mFzd6L |
| 043S-D09 | hFzd6L | FTFSSYAMH | 496 | SAISSNGGSTYYA | 1192 | CARVSRGGDFD YW | 1888 | hFzd6L, mFzd6L |
| 043S-E09 | hFzd6L | FTFSSYAMH | 497 | AVISYDGSNKYYA | 1193 | CAKEGWLLSYA FDIW | 1889 | hFzd6L, mFzd6L |
| 043S-F07 | hFzd6L | FTFSSYAMH | 498 | AVISYDGSNKYYA | 1194 | CVVRGDYW | 1890 | hFzd6L, mFzd6L |
| 043S-H07 | hFzd6L | FTFSSYAMH | 499 | AVISYDGSNKYYA | 1195 | CVVRGDYW | 1891 | hFzd6L, mFzd6L |
| 043S-F08 | hFzd6L | FTZSZYAMZ | 500 | SAISGSGGSTYYA | 1196 | CAKATANDAFD IW | 1892 | hFzd6L, mFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 043S-C09 | hFzd6L | FTFSSYAMS | 501 | SAISGSGGSTYYA | 1197 | CAKDSYYGSGS DDAFDIW | 1893 | hFzd6L, mFzd6L |
| 031S-G02 | hFzd7ext | FTFSSYGMH | 502 | AVISYDGSNKYYA | 1198 | CAKGTTAGW | 1894 | hFzd7L |
| 031S-A03 | hFzd7ext | YTFASYYIH | 503 | GIINPSGGRTTYA | 1199 | CARERSSGSYG MDVW | 1895 | hFzd7L |
| 031S-B03 | hFzd7ext | YTFTSYYMH | 504 | GIINPSSGSTSYA | 1200 | CARDKGGYSIY W | 1896 | hFzd7L |
| 031S-C03 | hFzd7ext | YTFTSYDIN | 505 | GVIDPTGEATLYA | 1201 | CARGSSSGWYY FDYW | 1897 | hFzd7L |
| 031S-D03 | hFzd7ext | YTFTNYYMH | 506 | GIINPSGGSTSYA | 1202 | CAREGRLSYGM DAW | 1898 | hFzd7L |
| 031S-E03 | hFzd7ext | YTFTSYHVH | 507 | GRINPHTGGTNYA | 1203 | CAATPRWTTWF QHW | 1899 | 6Fzd7L |
| 031S-F03 | hFzd7ext | YTFRDYYMH | 508 | GVINPSGGITSYA | 1204 | CARDLENGAIY FQHW | 1900 | hFzd7L |
| 031S-G03 | hFzd7ext | YTFTAYYMH | 509 | GIINPTDGGTTYA | 1205 | CARHGKWEPSL VDPW | 1901 | HFzd7L |
| 031S-H03 | hFzd7ext | FTFSSSAMH | 510 | AAVSRSGGSTFYA | 1206 | CAQQYYVLGEY FDYW | 1902 | hFzd2L, 7L |
| 031S-A04 | hFzd7ext | NTFIGYYVH | 511 | GWMNPNSGNTGYA | 1207 | CARGVDYMDVW | 1903 | HFzd7L |
| 031S-C04 | hFzd7ext | FTFSDYYMS | 512 | SSISSSSSYIYYA | 1208 | CARRIVGAAFD YW | 1904 | hFzd7L |
| 031S-D04 | hFzd7ext | HTLNSYYMH | 513 | GIINPRNGRTSYA | 1209 | CARDDKRTGTL DYW | 1905 | hFzd7L |
| 031S-E04 | hFzd7ext | FTFSSHGMH | 514 | SGINWNGGSTGYA | 1210 | CARVGNHDAFD IW | 1906 | hFzd7L |
| 031S-F04 | hFzd7ext | FTFSSYPMS | 515 | SAISGSGGSTYYA | 1211 | CAIRVRASGLF PNGMDVW | 1907 | hFzd2L, 7L |
| 031S-G04 | hFzd7ext | YTVTRSYMH | 516 | GWMNPNSGNTZYA | 1212 | CATGIAVAGIP YDYW | 1908 | hFzd7L |
| 031S-H04 | hFzd7ext | YTFTGYYMH | 517 | GIINPSGGSTTYA | 1213 | CARDQYYYGSG SQPGMDVW | 1909 | hFzd7L |
| 031S-A05 | hFzd7ext | YTFTSYYMH | 518 | GIISPSGGGTSYP | 1214 | CASQDVEGALD YW | 1910 | hFzd7L |
| 031S-B05 | hFzd7ext | GTFSSHAIS | 519 | GIINARTGTTDYA | 1215 | CARDMGDIW | 1911 | hFzd7L |
| 031S-C05 | hFzd7ext | FTFSNAWMS | 520 | SSISRDSRYIYYA | 1216 | CAAGQGGYFDY W | 1912 | hFzd7L |
| 031S-D05 | hFzd7ext | FTFSDYYMS | 521 | SYISGDSGYTNYA | 1217 | CARGGGDFDYW | 1913 | hFzd7L |
| 031S-E05 | hFzd7ext | YTFTSYDIN | 522 | GWMIPN5GNTAYA | 1218 | CARGGQQLDYY YYYGMDVW | 1914 | hFzd7L |
| 031S-F05 | hFzd7ext | GTFTSYALN | 523 | GMINPSSGSTNYA | 1219 | CTRLRRSEYYF DYW | 1915 | hFzd2L, 7L |
| 031S-G05 | hFzd7ext | GTFTNYHMH | 524 | GIINPSGGSTSYA | 1220 | CARDQWNIVGA TYYYGMDVW | 1916 | hFzd7L |
| 031S-A06 | hFzd7ext | YTFTNYYMH | 525 | GIINPSRGNTNYA | 1221 | CARHGRGRDFG MDVW | 1917 | hFzd7L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 031S-B06 | hFzd7ext | YTFTTYYMH | 526 | GIINPSGGSTSYA | 1222 | CARDGSGYEID YW | 1918 | hFzd7L |
| 031S-D06 | hFzd7ext | DSFTTYYIH | 527 | GIINPSGGSTSYA | 1223 | CARDPTTVTPL GYYYGMDVW | 1919 | hFzd7L |
| 031S-E06 | hFzd7ext | YTFSTHYMH | 528 | GIINPSGGSTSYA | 1224 | CARDLVAGYYF DYW | 1920 | hFzd7L |
| 031S-F06 | hFzd7ext | YTFTSHAIS | 529 | GWISAYNGNTKYV | 1225 | CTTRVGRYPTY YYGMDVW | 1921 | hFzd7L |
| 031S-G06 | hFzd7ext | FTFSSYAMH | 530 | AGTSGSGESRDYA | 1226 | CARGQVLRFFD VW | 1922 | hFzd1L, 2L, 7L |
| 031S-A07 | hFzd7ext | GTFSSYAIS | 531 | GWMNPNSGYTGYA | 1227 | CARTYGDYFDY W | 1923 | hFzd7L |
| 031S-C07 | hFzd7ext | GTFTGYAIN | 532 | GWMNPNSGNTGYA | 1228 | CARLTRKGADY YFDYW | 1924 | hFzd1L, 2L, 7L |
| 031S-E07 | hFzd7ext | FTFSSYWMH | 533 | STISASGGNTYYA | 1229 | CARGGSNYYYY GMDVW | 1925 | hFzd1L, 2L, 7L |
| 031S-H07 | hFzd7ext | YTFTSYYMH | 534 | GIINPSGGSTSYA | 1230 | CARGQGYMDVW | 1926 | hFzd7L |
| 031S-A08 | hFzd7ext | YTFTGYYMH | 535 | GIINPSDGETSYA | 1231 | CARDRPYYDGY GMDVW | 1927 | hFzd2L, 7L |
| 031S-B08 | hFzd7ext | YTFTKYYMH | 536 | GIINPVSGTTSYA | 1232 | CARVRRMGGHS DYW | 1928 | hFzd7L |
| 031S-C08 | hFzd7ext | GTFNNYALS | 537 | GIINPSGGSTSYA | 1233 | CAHIARKQYYF DYW | 1929 | hFzd2L, 7L |
| 031S-D08 | hFzd7ext | YTFTNYYMH | 538 | GIINPSGGSTSYA | 1234 | CARGSYPLAVG ATLYYYYGMD VW | 1930 | hFzd7L |
| 031S-E08 | hFzd7ext | YTFTGHYMH | 539 | GIINPSGGATIYA | 1235 | CTTDGGLGYAF DIW | 1931 | hFzd7L |
| 031S-F08 | hFzd7ext | FTFSSYGMH | 540 | AGVSYDKSQEYYA | 1236 | CTRPAKYGDLD YW | 1932 | hFzd7L |
| 031S-G08 | hFzd7ext | YTFSDHYMH | 541 | GWMNPKSGNTGYS | 1237 | CAKGVDTFDYW | 1933 | hFzd7L |
| 031S-H08 | hFzd7ext | FTFSSYGMS | 542 | SAISASGGYTYYA | 1238 | CARVGYYYGMD VW | 1934 | hFzd1L, 2L, 7L |
| 032S-G01 | mFzd7L | YTFTGYYMH | 543 | GIINPSGGGTSYA | 1239 | CARDSGSNGYA FDIW | 1935 | hFzd7L, mFzd7L |
| 032S-H01 | mFzd7L | YTFTDYYIQ | 544 | GIINPSGGITSYA | 1240 | CAKDRRQLVRS AWFDPW | 1936 | hFzd7L, mFzd7L |
| 032S-A02 | mFzd7L | YTFSGYGIS | 545 | GWMNPYSGNTGYA | 1241 | CARGPARRHYY YGMDVW | 1937 | hFzd7L, mFzd7L |
| 032S-B02 | mFzd7L | YPFIGXYLH | 546 | GWMNPKSGNTGYA | 1242 | CAKDLIAAAGT GYGMDVW | 1938 | hFzd7L, mFzd7L |
| 032S-F02 | hFzd7L | FTFSNAWMS | 547 | STIRASGGNTYYA | 1243 | CASGVYGMDVW | 1939 | hFzd7L hFzd7L, |
| 032S-D02 | hFzd7L | YTFTNYYMH | 548 | GVINTGGGSVTYA | 1244 | CARDLLGAVGY GMDVW | 1940 | mFzd7L |
| 032S-H02 | hFzd7L | HTFTSYYMH | 549 | GIINPSGGSTSYA | 1245 | CARDLTEAPTG TTRYYYYGMD VW | 1941 | hFzd7L, mFzd7L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 032S-A03 | hFzd7L | YTFTAYYVH | 550 | GIINPSGGYSTYA | 1246 | CARQYYDFWSG YPISGMDVW | 1942 | hFzd7L |
| 049S-B02 | hFzd7L | YTFTGYYMH | 551 | GWMNPNSGNT GYA | 1247 | CTTELDILTGY GFDYW | 1943 | hFzd7L, mFzd7L |
| 049S-D02 | HFzd7L | DTFTRYYIH | 552 | GIINPSSGSTSYA | 1248 | CARDLRDIVGA TRHYYYYGMDV W | 1944 | hFzd7L, mFzd7L |
| 049S-F02 | hFzd7L | YTFTGYYMH | 553 | GWMSPNSGNAGFA | 1249 | CASQYNWNDGY YYGMDVW | 1945 | hFzd7L, mFzd7L |
| 049S-H02 | hFzd7L | YTFTSYYMH | 554 | GIINPSGGSTSYA | 1250 | CARDRGSSGYY LGYW | 1946 | hFzd7L, mFzd7L |
| 049S-A03 | hFzd7L | YTITSFYMH | 555 | GWINPHSGDTYYA | 1251 | CARELGYGWFD PW | 1947 | hFzd7L, mFzd7L |
| 049S-B03 | hFzd7L | FTFSSYWMS | 556 | SAISSSGASTYYA | 1252 | CARGRDIGGIF DYW | 1948 | hFzd7L, mFzd7L |
| 049S-C03 | hFzd7L | YTFTTYSMQ | 557 | GWMSPNSGNTGYA | 1253 | CASGIGYYYGM DVW | 1949 | hFzd7 hFzd7L, |
| 049S-E03 | hFzd7L | YTFTGYFIH | 558 | GWISAYNGNTNYA | 1254 | CARDRSGYFDL W | 1950 | mFzd7L hFzd7L, |
| 049S-F03 | hFzd7L | NTFKGYYMH | 559 | GWMNVHTGNTGYA | 1255 | CAKVGGYSSSW YPSYYYGMDVW | 1951 | mFzd7L hFzd7L, |
| 049S-H03 | hFzd7L | YTFPAXYMH | 560 | GWISAYNGNTNYA | 1256 | CARDSLAGWFD PW | 1952 | mFzd7L hFzd7L, |
| 049S-A04 | hFzd7L | YTFTNYYVH | 561 | GIINPSGDGTNYA | 1257 | CARDQYGGYAF DYW | 1953 | mFzd7L hFzd7L, |
| 049S-B04 | hFzd7L | YTFTSYYMH | 562 | GWISAYNGNTNYA | 1258 | CVRSSGGYLDL W | 1954 | mFzd7L hFzd7L, |
| 049S-C04 | hFzd7L | YTFTGYYMH | 563 | GIINPSGGGTSYA | 1259 | CARDSGSNGYA FDIW | 1955 | mFzd7L |
| 15G4-4 | mFzd8L | GYTFTDYYM N | 564 | GDINPNNGGSRYN | 1260 | CAREGRYGYDG AWFAYW | 1956 | mFzd8L |
| 027S-E5 | hFzdS | GTFSSYAIS | 565 | GMINPSGGSTTYA | 1261 | CARQAGLHCSS TSCYLGNWFDP W | 1957 | hFzd8 |
| 037S-A01 | hFzd9L | YKFNSNAMN | 566 | GGIIPIFGTANYA | 1262 | CARFGWYYYGM DVW | 1958 | hFzd9L |
| 050S-A01 | hFzd9L | GTFNIYAIS | 567 | GWINPNSGNTGYA | 1263 | CAKYSSSWYGQ DQHDAFDIW | 1959 | hFzd9, mFzd9 |
| 050S-B01 | hFzd9L | YTFTDYHMH | 568 | GWMNPNSGNTGYA | 1264 | CARDDPYGYFL MDFW | 1960 | hFzd9, mFzd9 |
| 050S-C01 | hFzd9L | YTFTSYYMH | 569 | GIINPNGGZTSYA | 1265 | CARDSDYDWSW FYPW | 1961 | hFzd9, mFzd9 |
| 050S-D01 | hFzd9L | YTFTSYYMN | 570 | GWINPNTGDTSFA | 1266 | CAKEADGNYFY GIDVW | 1962 | hFzd9, mFzd9 |
| 050S-E01 | hFzd9L | YSFTSYGIT | 571 | GGIIPVFVTPRYA | 1267 | CTTSLYYDSSG YYSSPYYYYG MDVW | 1963 | hFzd9, mFzd9 |
| 050S-F01 | hFzd9L | YTVTDYYMH | 572 | GIINPYGGGTSYG | 1268 | CAREYSSSLVF DLW | 1964 | hFzd9, mFzd9 |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 050S-G01 | hFzd9L | YTFTTYYIH | 573 | GWINPNGGZTSYA | 1269 | CARDRCYDFW | 1965 | hFzd9, mFzd9 |
| 050S-H01 | hFzd9L | STFISAYMH | 574 | GWMNPNSGNTGYA | 1270 | CATSSSGEHYY MDVW | 1966 | hFzd9, mFzd9 |
| 050S-A02 | hFzd9L | YTFTSYYMH | 575 | GIINPNGGTTSYA | 1271 | CARDSDYDWSW FYPW | 1967 | hFzd9, mFzd9 |
| 050S-B02 | hFzd9L | YTFTSYYMH | 576 | GIINPSGGSTNYA | 1272 | CAKGSPYDWGY FDYW | 1968 | hFzd9, mFzd9 |
| 050S-C02 | hFzd9L | YTFTSYDIN | 577 | GWIDPSSGATDYA | 1273 | CARDGGLLRNY YYGMDVW | 1969 | hFzd9, mFzd9 |
| 050S-D02 | hFzd9L | GTFDTFAIS | 578 | GWINPNSGGTNYA | 1274 | CAKHWVGKGMD VW | 1970 | hFzd9, mFzd9 |
| 050S-E02 | hFzd9L | YTFTSYDIN | 579 | GIIDPSGGSTDYA | 1275 | CARDGWPAAQL YYYYGMDVW | 1971 | hFzd9, mFzd9 |
| 050S-F02 | hFzd9L | YTFTGYFIH | 580 | GIINPSSGNTNYA | 1276 | CAKGRYSGGWG DFDWW | 1972 | hFzd9, mFzd9 |
| 050S-G02 | hFzd9L | YTFTSYYMH | 581 | GRINPNGGNTSYA | 1277 | CARDIYNYYYY GMDGW | 1973 | hFzd9, mFzd9 |
| 050S-H02 | hFzd9L | YTFTGYYMH | 582 | GWMNPNSGNTGYA | 1278 | CARDYSRYYYG MDVW | 1974 | hFzd9, mFzd9 |
| 050S-A03 | hFzd9L | YTFTSYYMH | 583 | GIINPSGGSTSYA | 1279 | CARESGYDWSW FDPW | 1975 | hFzd9, mFzd9 |
| 050S-B03 | hFzd9L | YTFTNYYVH | 584 | GIINPSGGNTSYA | 1280 | CARHRDNWNYD GMDVW | 1976 | hFzd9, mFzd9 |
| 050S-C03 | hFzd9L | YTFPNYYMH | 585 | GIINPSGAGTTYA | 1281 | CAKEHSGNCYA FDIW | 1977 | hFzd9, mFzd9 |
| 050S-D03 | hFzd9L | YTFTSYYMH | 586 | GIINPZGGSTSYA | 1282 | CARDSGYDWSW FDPW | 1978 | hFzd9, mFzd9 |
| 050S-E03 | hFzd9L | YTFTSYYIH | 587 | GWINPZSGDTIYA | 1283 | CARDKCNSNYC LINGMDVW | 1979 | hFzd9, mFzd9 |
| 050S-F03 | hFzd9L | YTFTSYYMH | 588 | GWINPSSGSTTYA | 1284 | CARDLSGNWYG ALDYW | 1980 | hFzd9, mFzd9 |
| 050S-G03 | hFzd9L | YTFTSYYMH | 589 | GIINPNGGZTSYA | 1285 | CARDSDYDWSW FYPW | 1981 | hFzd9, mFzd9 |
| 050S-H03 | hFzd9L | YTFTNYYIH | 590 | GIINPZGGNTIYA | 1286 | CAKDRDNCYYY YLDVW | 1982 | hFzd9, mFzd9 |
| 050S-A04 | hFzd9L | YTVTDYYMH | 591 | GIINPYGGGTSYG | 1287 | CAREYSSSLVF DLW | 1983 | hFzd9, mFzd9 |
| 050S-B04 | hFzd9L | YTFTRYAMN | 592 | GWMNPNSGDTGYA | 1288 | CARGPAVGASY YYYYGMDVW | 1984 | hFzd9, mFzd9 |
| 050S-C04 | hFzd9L | YTFTSYYMH | 593 | GIINPNSGSTSYA | 1289 | CARGFRDDFSF SDLW | 1985 | hFzd9, mFzd9 |
| 050S-D04 | hFzd9L | YTFTSYYMH | 594 | GIINPNGGTTSYA | 1290 | CARESGYDWSW FDPW | 1986 | hFzd9, mFzd9 |
| 050S-E04 | hFzd9L | YTZTDYYMH | 595 | GIINPYGGGTSYG | 1291 | CAREYSSSLVF DLW | 1987 | hFzd9, mFzd9 |
| 050S-F04 | hFzd9L | YTFTDYYMH | 596 | GWMNPNSDNTGYA | 1292 | CAREGYYYGMD VW | 1988 | hFzd9, mFzd9 |

TABLE 2-continued

Clone IDs and CDR sequences for hinge specific ("L") or hinge (L) + CRD ("ext") binders. "CDRH" indicates heavy chain CDRs, and "CDRL" indicates light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 050S-G04 | hFzd9L | YSFTGYYMH | 597 | GWTDPISGDTSYA | 1293 | CARNPLYGDYG AIDYW | 1989 | hFzd9, mFzd9 |
| 050S-H04 | hFzd9L | YTFTSYYMH | 598 | GIINPSGGSTSYA | 1294 | CARDRDSDYYE WGYFDLW | 1990 | hFzd9, mFzd9 |
| 050S-A05 | hFzd9L | YTFTSYYMH | 599 | GIINPSGGYTTYA | 1295 | CARGAESSGWS QFDYW | 1991 | hFzd9, mFzd9 |
| 050S-B05 | hFzd9L | YTFTSYYMH | 600 | GIINPSGGSTSYG | 1296 | CARGGSYDFGA FDIW | 1992 | hFzd9, mFzd9 |
| 050S-C05 | hFzd9L | YAFTSYYVH | 601 | GIINPSEGSTNYA | 1297 | CARGENSDWGA FDIW | 1993 | hFzd9, mFzd9 |
| 050S-D05 | hFzd9L | YTFTDYYMH | 602 | GIINPNGGSTSYA | 1298 | CARESGYYPST SNDAFDIW | 1994 | hFzd9, mFzd9 |
| 050S-E05 | hFzd9L | YTFTGYYMH | 603 | GIINPRVGSTTNA | 1299 | CAKGASGHDWG IFDYW | 1995 | hFzd9, mFzd9 |
| 050S-F05 | hFzd9L | YTFTSYFMH | 604 | GWINPNSGATTYA | 1300 | CARDLVWASSG WGMDVW | 1996 | hFzd9, mF7d9 |
| 050S-G05 | hFzd9L | YTFTSYYMH | 605 | GWMNPNSGDTGYA | 1301 | CARDQGWAGVP AADYYYYGMDV W | 1997 | hFzd9, mFzd9 |
| 050S-H05 | hFzd9L | YTFTSYYMH | 606 | GIINPTV6STTYA | 1302 | CAKGWDSSGWA NFDYW | 1998 | hFzd9, mFzd9 |
| 050S-A06 | hFzd9L | YTFTGYYMH | 607 | GVINPSGGSTTYA | 1303 | CARDRSSWPDY YYYYGMDVW | 1999 | hFzd9, mFzd9 |
| 050S-B06 | hFzd9L | YTFTSYFMH | 608 | GWINPNSGATTYA | 1304 | CARDLVWASSG WGMDVW | 2000 | hFzd9, mFzd9 |
| 050S-C06 | hFzd9L | YTVTSHYMN | 609 | GWMNPYTGNTGFA | 1305 | CAREAEGNQIY GMDVW | 2001 | hFzd9, mFzd9 |
| 050S-D06 | hFzd9L | GTFSSYAIS | 610 | GIINPRDGDTVYA | 1306 | CARDVTDYGDY VASWYFDLW | 2002 | hFzd9, mFzd9 |
| 050S E06 | hFzd9L | YTFTNYYMH | 611 | GWINPNSGATTYA | 1307 | CARDLTPDYYG AADYW | 2003 | hFzd9, mFzd9 |
| 050S-F06 | hFzd9L | GAFSSYAIS | 612 | GWMSPNSGDTGYA | 1308 | CARHAEGRSAD YW | 2004 | hFzd9, mFzd9 |
| 050S-G06 | hFzd9L | YTVTDYYMH | 613 | GZISPYZGGTSYG | 1309 | CAREYSSSWFD LW | 2005 | hFzd9, mFzd9 |
| 050S-A07 | hFzd9L | YTFTGYYMH | 614 | GWINPNNGATNYA | 1310 | CAKDKTYYDFW SGYGFDYW | 2006 | hFzd9, mFzd9 |
| 050S-B07 | hFzd9L | YTFTTYYVH | 615 | GIINPSSGSTTYA | 1311 | CAKDRVYGDYG DAFDIW | 2007 | hFzd9, mFzd9 |
| 050S-D07 | hFzd9L | YTFTSYYMH | 616 | GIVNPSSGSTTYA | 1312 | CARDRDPYYYY YGMDVW | 2008 | hFzd9, mFzd9 |
| 050S-E07 | hFzd9L | YTFTGYYMH | 617 | GWTZPISGDTNYA | 1313 | CAKNPLYGDCG AFDYW | 2009 | hFzd9, mFzd9 |
| 050S-F07 | hFzd9L | YTVTDYYMH | 618 | GIINPYGGGTSYG | 1314 | CAREYSSSLVF DLW | 2010 | hFzd9, mFzd9 |
| 050S-G07 | hFzd9L | FTFSSYXMS | 619 | SYISGDSGYTNYA | 1315 | CARGVAAADYW | 2011 | hFzd9, mFzd9 |
| 050S-A08 | hFzd9L | YSFTZYYMM | 620 | GWTDHISGDTSYA | 1316 | CARNPLYGDYG AIDYW | 2012 | hFzd9, mFzd9 |

TABLE 2-continued

Clone IDs and CDR sequences for hinge specific ("L") or hinge (L) + CRD ("ext") binders. "CDRH" indicates heavy chain CDRs, and "CDRL" indicates light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|----------|---------|-------|--------------|-------|--------------|-------|--------------|-------------------|
| 050S-B08 | hFzd9L | YTFTSYYIH | 621 | GIINPSGGTTTYA | 1317 | CARDSSGWHPI PWGYFDLW | 2013 | hFzd9, mFzd9 |
| 050S-C08 | hFzd9L | YTFTGYYMH | 622 | GWMNPNSGNTGYA | 1318 | CAREEGSGWYG MDVW | 2014 | hFzd9, mFzd9 |
| 050S-D08 | hFzd9L | YTFTSYYMH | 623 | GIINPNGGTTTYA | 1319 | CARDIDYDWSW FYPC | 2015 | hFzd9, mFzd9 |
| 050S-E08 | hFzd9L | YTFTGYYMH | 624 | GVINPNGGSTTYA | 1320 | CAKDIGASRYY YMDVW | 2016 | hFzd9, mFzd9 |
| 050S-F08 | hFzd9L | YTLTSYYIH | 625 | GIINPNSGGTNYA | 1321 | CARHKAAAAGT QYYNGMDVW | 2017 | hFzd9, mFzd9 |
| 050S-G08 | hFzd9L | YTFTSYYMH | 626 | GVINPTAGDTTYA | 1322 | CARDISWFGPM DVW | 2018 | hFzd9, mFzd9 |
| 050S-H08 | hFzd9L | YTVTDYYMH | 627 | GIINPYGGGTSYG | 1323 | CAREYSSSLVF DLW | 2019 | hFzd9, mFzd9 |
| 050S-A09 | hFzd9L | YTFTSYYMH | 628 | GIINPNGGZTSYA | 1324 | CARDSGYDWSW FYPC | 2020 | hFzd9, mFzd9 |
| 050S-B09 | hFzd9L | YTFTZYYMH | 629 | GIINPYGGGTSYG | 1325 | CAREYSSSLVF DLW | 2021 | hFzd9, mFzd9 |
| 050S-C09 | hFzd9L | YTFTSYYMH | 630 | GRINPNTGGTNYA | 1326 | CAKDLTYDFWS GWGMDVW | 2022 | hFzd9, mFzd9 |
| 050S-D09 | hFzd9L | YTFTDYYMH | 631 | GIINPYGGGTSYG | 1327 | CAREYSSSLVF DLW | 2023 | hFzd9, mFzd9 |
| 050S-E09 | hFzd9L | YTFTDYYIH | 632 | GWININSGGTNSG | 1328 | CARDRDRYSYG SGDYW | 2024 | hFzd9, mFzd9 |
| 050S-F09 | hFzd9L | YTFTGNFIH | 633 | GIINPSSGNTNYA | 1329 | CAKGRYSSGWG DFDYW | 2025 | hFzd9, mFzd9 |
| 050S-G09 | hFzd9L | YTVTDYYMH | 634 | GIINPYGGGTSYG | 1330 | CAREYSSSLVF DLW | 2026 | hFzd9, mFzd9 |
| 050S-H09 | hFzd9L | GTFSSYAIS | 635 | GWINPNSGGTNYA | 1331 | CARGRYYGSGS YHFDYW | 2027 | hFzd9, mFzd9 |
| 050S-A10 | hFzd9L | YTFTSYDIN | 636 | GWINPNSGATNYA | 1332 | CARGTMTTWYL FDYW | 2028 | hFzd9, mFzd9 |
| 050S-B10 | hFzd9L | YTFTSYYMH | 637 | GIINPZGGTTSYA | 1333 | CARDSGYDWSC FYPW | 2029 | hFzd9, mFzd9 |
| 050S-C10 | hFzd9L | YTFTDYYMH | 638 | GIINPYGGGTSYG | 1334 | CAREYSSSLVF DLW | 2030 | hFzd9, mFzd9 |
| 050S-D10 | hFzd9L | YTFTGYYMH | 639 | GWINPNNGATNYA | 1335 | CAKDKTYYDFW SGYGFDYW | 2031 | hFzd9, mFzd9 |
| 050S-E10 | hFzd9L | YTFTZYYMH | 640 | ZIINPSZZSTSZA | 1336 | YSRGSGYDWSW FDPW | 2032 | hFzd9, mFzd9 |
| 050S-F10 | hFzd9L | YSFTSYFVH | 641 | GIINPSGGATIYA | 1337 | CARGGVRGYSG YDPFDYW | 2033 | hFzd9, mFzd9 |
| 050S-G10 | hFzd9L | YSFTSYYMH | 642 | GRMNPNGGNTGYA | 1338 | CARDKYLYYYG MDVW | 2034 | hFzd9, mFzd9 |
| OSOS-H10 | hFzd9L | YTFTSHYMH | 643 | GIVNPSSGSTTYA | 1339 | CARMGASGSGW YHWFDPW | 2035 | hFzd9, mFzd9 |
| 050S-A11 | hFzd9L | YTFSDYYIH | 644 | GIINPIDGGTTYA | 1340 | CARDMTVGNWG YFDYW | 2036 | hFzd9, mFzd9 |

TABLE 2-continued

Clone IDs and CDR sequences for hinge specific ("L") or hinge (L) + CRD ("ext") binders. "CDRH" indicates heavy chain CDRs, and "CDRL" indicates light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 050S-B11 | hFzd9L | YTFTNYYMH | 645 | GIINPSGGSTSYA | 1341 | CARELDDYGDY VAGFDPW | 2037 | hFzd9, mFzd9 |
| 050S-C11 | hFzd9L | YTFZSYYMH | 646 | ZIINPSGGSTSYA | 1342 | CARGSGYDWSW LDPW | 2038 | hFzd9, mFzd9 |
| 050S-D11 | hFzd9L | YTFTSYYMH | 647 | GIINPSGGTTSYA | 1343 | CARDSGYDWSW FDPW | 2039 | hFzd9, mFzd9 |
| 050S-E11 | hFzd9L | YTVTDYYMH | 648 | GIINPYGGGTSYG | 1344 | CAREYSSSLVF DLW | 2040 | hFzd9, mFzd9 |
| 050S-F11 | hFzd9L | YTFTSYYMH | 649 | GIINPVGGSTTYA | 1345 | CARDSFSAAGM FGWFDPW | 2041 | hFzd9, mFzd9 |
| 050S-G11 | hFzd9L | YTFPNYYMH | 650 | GIINPSGGSTTYA | 1346 | CARGHSYDWGA FDIW | 2042 | hFzd9, mFzd9 |
| 050S-H11 | hFzd9L | YTFTNYYLH | 651 | GIINPSGGSTSYA | 1347 | CARGADSSGWS DFQHW | 2043 | hFzd9, mFzd9 |
| 050S-A12 | hFzd9L | YTFTSYYMH | 652 | GZINPZGGTTTYA | 1348 | CARDSGYDWSC YYPW | 2044 | hFzd9, mFzd9 |
| 050S-B12 | hFzd9L | YSFTGFYMH | 653 | GWISPYNGNAKYA | 1349 | CAREGYSYGYD YW | 2045 | hFzd9, mFzd9 |
| 050S-C12 | hFzd9L | YTF7SYYMH | 654 | GWINPNTGGTNYA | 1350 | CAKDLTYDFWS GWGMDVW | 2046 | hFzd9, mFzd9 |
| 050S-D12 | hFzd9L | YSFTSYYMH | 655 | GWMNPNSGNTGYA | 1351 | CARDKYLYYYG MDVW | 2047 | hFzd9, mFzd9 |
| 050S-E12 | hFzd9L | ZTFSNYAIZ | 656 | GWINPZRGDTMYA | 1352 | CAKDQYSNYYY YYYGMDVW | 2048 | hFzd9, mFzd9 |
| 050S-F12 | hFzd9L | YTZTDYYMH | 657 | GIISPYGGGTSYG | 1353 | CARENSSSLVF DLW | 2049 | hFzd9, mFzd9 |
| 050S-G12 | hFzd9L | GTFSNYAIS | 658 | GWINPKRGDTMYA | 1354 | CAKDQYSNYYY YYYGMDVW | 2050 | hFzd9, mFzd9 |
| 051S-A01 | hFzd9L | YTFTGHYMH | 659 | GVINPSGGSTSYA | 1355 | CARDRAGDYDG WGYFDLW | 2051 | hFzd9, mFzd9 |
| 051S-B01 | hFzd9L | YTFTSNYVH | 660 | GIINPSGGSTSYA | 1356 | CARQRDNWNYD GMDVW | 2052 | hFzd9, mFzd9 |
| 051S-C01 | hFzd9L | YTFTSYYVH | 661 | GIINPSIGSTTYA | 1357 | CARGADSSGWS DFQHW | 2053 | hFzd9, mFzd9 |
| 051S-E01 | hFzd9L | YTFTNSYIH | 662 | GWMSPNSGATNYA | 1358 | CAREIAAAEYI DYW | 2054 | hFzd9, mFzd9 |
| 051S-F01 | hFzd9L | YTFTSYYMH | 663 | GIINPSGGSTSYA | 1359 | CARGSGYDWSW FDPW | 2055 | hFzd9, mFzd9 |
| 051S-G01 | hFzd9L | YTFTNYYIN | 664 | GIINPSDGSTTYA | 1360 | CARQPKGYYYY GMDVW | 2056 | hFzd9, mFzd9 |
| 051S-H01 | hFzd9L | YTFTGYYMH | 665 | GWINPNSGNTGYA | 1361 | CARDDSSGYYG MDVW | 2057 | hFzd9, mFzd9 |
| 051S-A02 | hFzd9L | YTFADYNLH | 666 | GRIIPILGIANYA | 1362 | CARQFEFW | 2058 | hFzd9, mFzd9 |
| 046S-C02 | hFzd10L | YTFTSYDMH | 667 | GWINPNSGGTNYA | 1363 | CVVFGSHNLDY W | 2059 | hFzd10L, mFzd10L |
| 046S-E02 | hFzd10L | YTFTSYYMH | 668 | GWVNPNIGGTNYE | 1364 | CAAGADVW | 2060 | hFzd10L, mFzd10L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 046S-H02 | hFzd10L | FTFSSYWMH | 669 | ALISYSGSEKYYA | 1365 | CARDSYGDYPY NWFDPW | 2061 | hFzd10L, mFzd10L |
| 046S-A03 | hFzd10L | YTFTNYYIH | 670 | GWMNPNSGYTGYA | 1366 | CARGDYGDYAG NYFDYW | 2062 | hFzd10L, mFzd10L |
| 046S-F03 | hFzd10L | YTFTHHSIH | 671 | GRISPHDGGTIYA | 1367 | CASGGTTYYYY GMDVW | 2063 | hFzd10L, mFzd10L |
| 046S-B04 | hFzd10L | GTFSSYAIS | 672 | GGIIPIFGTANYA | 1368 | CARVGGGMDVW | 2064 | hFzd10L, mFzd10L |
| 046S-A05 | hFzd10L | LSFGDYAIH | 673 | SAIGAGGGTYYA | 1369 | CARDEDGSGWL DYW | 2065 | hFzd10L, mFzd10L |
| 046S-G01 | hFzd10L | FTFSSYGMH | 674 | SAISSSGTDIYYA | 1370 | CARGGSYYVDY GMDVW | 2066 | hFzd10L |
| 046S-A02 | hFzd10L | FTFSSSAMH | 675 | SGISGSGYTTYYA | 1371 | CTTDGMDVW | 2067 | hFzd10L |
| 046S-B03 | hFzd10L | FSFTRYDMH | 676 | SGISWNSGSIGYA | 1372 | CARGGLGFDYW | 2068 | hFzd10L |
| 046S-A04 | hFzd10L | YTFTDYYMH | 677 | GVINPISGTVTYA | 1373 | CARGGSYQAFD YW | 2069 | hFzd10L |
| 046S-C05 | hFzd10L | YTLASYGIS | 678 | GWINPNSGGTHYA | 1374 | CARDGYDFWSG YPNYYYYGMD VW | 2070 | hFzd10L, mFzd10L |
| 046S-F05 | hFzd10L | FSFRSYAMT | 679 | SDVSGSGGGTYYA | 1375 | CARDGRTGTRY YYYMDVW | 2071 | hFzd10L, mFzd10L |
| 046S-A06 | hFzd10L | FTFDDYAMH | 680 | SVISWDGSIQYYA | 1376 | CARDPLYGMDV W | 2072 | hFzd10L |
| 046S-G06 | hFzd10L | GTFSSYAIS | 681 | GWMNPNNGDTNYA | 1377 | CARENYGDDDY YYYGMDVW | 2073 | hFzd10L, mFzd10L |
| 046S-D07 | hFzd10L | FTFSSYGMH | 682 | SAISGSGGSTYYA | 1378 | CARQENHYYGM DVW | 2074 | hFzd10L |
| 046S-E07 | hFzd10L | YTFTNYYMH | 683 | GIINPNSGGTNYA | 1379 | CARMYSSSDGM DVW | 2075 | hFzd10L |
| 046S-F07 | hFzd10L | FTFSSHAMH | 684 | AVMSYDGRHEYYA | 1380 | CARNIAAAAYG MDVW | 2076 | hFzd10L, mFzd10L |
| 046S-G07 | hFzd10L | FTFSSHAMH | 685 | AVMSYDGRHEYYA | 1381 | CARSIAAAAYG MDVW | 2077 | hFzd10L, mFzd10L |
| 046S-H07 | hFzd10L | YTFTSYYVH | 686 | GIINPSGGSTSYA | 1382 | CARDPGFHYGS GSYYNVSVGWF DPW | 2078 | hFzd10L, mFzd10L |
| 046S-E08 | hFzd10L | YTFTSYYMH | 687 | GGIIPMFGQTNYA | 1383 | CARSGYSGYDP FDYW | 2079 | hFzd10L, mFzd10L |
| 046S-G08 | hFzd10L | YTFTENEMH | 688 | GWINPNSGNRGYA | 1384 | CARVGITGTTG DYYGMDVW | 2080 | hFzd10L |
| 046S-AG9 | hFzd10L | GTFSSLDIN | 689 | GWMNPNSGNTGYA | 1385 | CARGADYW | 2081 | hFzd10L |
| 046S-F09 | hFzd10L | FTFSSYGIH | 690 | SAIGTGGGTYYA | 1386 | CARGNSAVAYG MDVW | 2082 | hFzd10L |
| 046S-D10 | hFzd10L | GTFTSYPIS | 691 | GIIRTGNGNTAYA | 1387 | CASEVLGAEYF QIW | 2083 | hFzd10L, mFzd10L |
| 046S-F10 | hFzd10L | GTFSSYAIS | 692 | GVINLSGGTTSYA | 1388 | CARDLEQLADK YYYYGMDVW | 2084 | hFzd10L, mFzd10L |
| 046S-G10 | hFzd10L | YTFSDYYMY | 693 | GIINPSGGSTSYA | 1389 | CATEPRWAAGR AFDIW | 2085 | hFzd10L, mFzd10L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 046S-D11 | hFzd10L | YTFTSYYMH | 694 | GWMNPNSGNTGYA | 1390 | CARMYGSGYGM DVW | 2086 | hFzd10L mFzd10L |
| 046S-F11 | hFzd10L | YTFTNYDIN | 695 | GWMNRNSGNTGYA | 1391 | CARPPVCYSGY DCPYYFDYW | 2087 | hFzd10L, mFzd10L |
| 046S-G11 | hFzd10L | LSVSNNYMS | 696 | SAISGSGGSTYYA | 1392 | CARDHAVYGMD VW | 2088 | hFzd10L hFzd10L, |
| 046S-E12 | hFzd10L | GTFSSYAFS | 697 | GWINPNSGGTDYA | 1393 | CAREDYYYGMD VW | 2089 | mFzd10L hFzd10L, |
| 046S-G12 | hFzd10L | FTFSDYYMS | 698 | GFIRSKAYGGTTE YA | 1394 | CASVDEGYW | 2090 | mFzd10L |
| 047S-A01 | hFzd10L | YTFANYGIS | 699 | GVIYPGDSDTRYS | 1395 | CTSADAYYYYG MDVW | 2091 | hFzd10L, mFzd10L |
| 047S-B01 | hFzd10L | YTFTSYYIH | 700 | GGIIPVFGTPNYA | 1396 | CVLEGRVQHW | 2092 | hFzd10L |
| 047S-E01 | hFzd10L | FTFSSYXMS | 701 | SAIGTGGGTYYA | 1397 | CARDSYGMDVW | 2093 | hFzd10L, mFzd10L |
| 047S-A02 | hFzd10L | FTFSSYWMH | 702 | AVLSYDARNTYYA | 1398 | CARDYYGSLDF W | 2094 | hFzd10L |
| 047S-C02 | hFzd10L | FTFSSYGMH | 703 | SAIGTGGGTYYA | 1399 | CARDRVVNDW | 2095 | hFzd10L |
| 047S-E02 | hFzd10L | YTFTDYYMH | 704 | GWMNPNSGDTGYA | 1400 | CARQVPSSSAH YYYGMDVW | 2096 | hFzd10L, mFzd10L |
| 047S-F02 | hFzd10L | FTFSSYXMT | 705 | SAIGTGGGTYYA | 1401 | CARAYYGFDYW | 2097 | hFzd10L, mFzd10L |
| 047S-F03 | hFzd10L | FTVGSWYMS | 706 | SGLSGSGDTSYYA | 1402 | CARDTHYGMDV W | 2098 | hFzd10L, mFzd10L |
| 047S-G03 | hFzd10L | YTFTSYYLH | 707 | GIINPSGGSTSFA | 1403 | CARWNEGFGVV TGDYFDYW | 2099 | hFzd10L |
| 047S-D04 | hFzd10L | YTFTGYYMH | 708 | GMINPSGGSTNYA | 1404 | CAREGGDYIFD YW | 2100 | hFzd10L, mFzd10L |
| 047S-E04 | hFzd10L | FTFDDYAMH | 709 | AVISYDGSNKYYA | 1405 | CATGYCSGGSC YLTGYW | 2101 | hFzd10L |
| 047S-H04 | hFzd10L | YTFTNYYMH | 710 | GWMNPNSGGTNYA | 1406 | CARDPGNYYYY GMDVW | 2102 | hFzd10L, mFzd10L |
| 047S-C05 | hFzd10L | FTFSRHGMH | 711 | SAMSGSGSYKYYA | 1407 | CARVGSGYDFF YYMDVW | 2103 | hFzd10L |
| 047S-E05 | hFzd10L | GTFSSYAIS | 712 | GWVNPTSGNTGYA | 1408 | CARESGDYDEA LDYW | 2104 | hFzd10L, mFzd10L |
| 047S-F05 | hFzd10L | YTFTSYYMH | 713 | GMINPNGGGTTYT | 1409 | CTTDRGDLW | 2105 | hFzd10L, mFzd10L |
| 047S-G05 | hFzd10L | FTVSPYWMT | 714 | AVISYDGSNKYYA | 1410 | CARAYNSWFDP W | 2106 | hFzd10L, mFzd10L |
| 047S-C06 | hFzd10L | FTFSSYXMS | 715 | SSISSSSSYIYYA | 1411 | CARDHDDYGMD VW | 2107 | hFzd10L, mFzd10L |
| 047S-E06 | hFzd10L | FTFSDYWMS | 716 | SAISGSGGSTYYA | 1412 | CARDGDYYGMD AW | 2108 | hFzd10L, mFzd10L |
| 047S-F06 | hFzd10L | FTFSSYAMH | 717 | GFIRSKAYGGTTE YA | 1413 | CARGDYW | 2109 | hFzd10L, mFzd10L |
| 047S-G06 | hFzd10L | YTFTTSYIH | 718 | GIINPSGGSTSYA | 1414 | CATAIREDGFD YW | 2110 | hFzd10L, mFzd10L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 047S-A07 | hFzd10L | FTFSSSAKH | 719 | STISSDGRTYYA | 1415 | CAKGRAYYYDS SGLLPDW | 2111 | hFzd10L, mFzd10L |
| 047S-B07 | hFzd10L | FTFSGYGMH | 720 | SAIGTGGGTYYA | 1416 | CARVRPYYYYY GMDVW | 2112 | hFzd10L |
| 047S-C07 | hFzd10L | FTFSSYXMS | 721 | SVISTSGDTVLYT | 1417 | CARGRLGGYFD LW | 2113 | hFzd10L, mFzd10L |
| 047S-F07 | hFzd10L | FTFSSYXMS | 722 | TLMSSDGNEEYYA | 1418 | CTTADYW | 2114 | hFzd10L, mFzd10L |
| 047S-G07 | hFzd10L | YTFTNYYMH | 723 | GWMNPNSGNTGYA | 1419 | CARMYSSSDGM DVW | 2115 | hFzd10L |
| 047S-H07 | hFzd10L | YTFTGYYMH | 724 | GWVNPNSGNTGYA | 1420 | CARDGWEQHAR SGYYYYGMDVW | 2116 | hFzd10L, mFzd10L |
| 047S-A08 | hFzd10L | YTFTNYYMH | 725 | GWMNPNSGGTNYA | 1421 | CARDPGNYYYY GMDVW | 2117 | hFzd10L, mFzd10L |
| 047S-C08 | hFzd10L | FTFSNHYTS | 726 | SAIGTIDDTYYS | 1422 | CTTDYGWLGYW | 2118 | hFzd10L, mFzd10L |
| 047S-D08 | hFzd10L | FTFSSYXMS | 727 | SGISANGATTYYA | 1423 | CARDHDYYGMD VW | 2119 | hFzd10L, mFzd10L |
| 047S-B11 | hFzd10L | DSVSSNSAA WN | 728 | GRTYFRSKWYTEY A | 1424 | CVRGGYDFDSW | 2120 | hFzd10L, mFzd10L |
| 047S-E12 | hFzd10L | FTFSSYGMH | 729 | AAISYDGSNKYFA | 1425 | CARDGGKNGWH FDYW | 2121 | hFzd10L, mFzd10L |

(light chain CDRs)

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 031S-A01 | hFzd1ext | QASEDISNY LH | 2122 | GASTLQS | 2816 | CQQSYSPPWTF | 3510 | hFzd1L, 2L, 7L |
| 032S-A01 | hFzd1L | RASQGIGNS LA | 2123 | RASSLES | 2817 | CQQAHSFPPTF | 3511 | hFzd1L, mFzd1L |
| 033S-A01 | hFzd1L | RSSQSLLHS NGYNYLD | 2124 | LGSKRAS | 2818 | CMQALQTPLTF | 3512 | hFzd1L, mFzd1L |
| 033S-B01 | hFzd1L | RSSQSLLHS NGYNYLD | 2125 | GASSLQN | 2819 | CMQALQTPLTF | 3513 | hFzd1L, mFzd1L |
| 033S-C01 | hFzd1L | RSSQSLLHS NGYNYLD | 2126 | LGSSRAS | 2820 | CMQALQTPLTF | 3514 | hFzd1L, mFzd1L |
| 033S-E01 | hFzd1L | RSSQSLLHS NGYNYLD | 2127 | LGSNRAS | 2821 | CMQALQTPLIF | 3515 | hFzd1L, mFzd1L |
| 033S-F01 | hFzd1L | RSSQSLLHS NGYNYLD | 2128 | MGSNRAS | 2822 | CMQALQTPLTF | 3516 | hFzd1L, mFzd1L |
| 033S-G01 | hFzd1L | RSSQSLLHS NGYNYLD | 2129 | LGSNRAS | 2823 | CMQSLQTPLTF | 3517 | mFzd1L |
| 033S-H01 | hFzd1L | RSSQSLLHS NGYNYLD | 2130 | LGSNRAS | 2824 | CMQALQTPITF | 3518 | hFzd1L, mFzd1L |
| 033S-B02 | hFzd1L | RSSQSLLHS NGYNYLD | 2131 | LGSNRAS | 2825 | CMQTLQAPLTF | 3519 | hFzd1L, mFzd1L |
| 033S-C02 | hFzd1L | RSSQSLLHS NGYNYLD | 2132 | LGSNRAS | 2826 | CMQALQTPLTF | 3520 | hFzd1L, mFzd1L |
| 033S-D02 | hFzd1L | RSSQSLLHS NGYNYLD | 2133 | LGSHRAS | 2827 | CMQGLQTPITF | 3521 | hFzd1L, mFzd1L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|----------|---------|-------|--------------|-------|--------------|-------|--------------|-------------------|
| 033S-E02 | hFzd1L | RSSQSLLHS NGYNYLD | 2134 | LGSNRAS | 2828 | CMQALQTPLTF | 3522 | hFzd1L, mFzd1L |
| 033S-F02 | hFzd1L | RSSQSLLHS NGYNYLD | 2135 | FGSNRAS | 2829 | CMQALQTPLTF | 3523 | hFzd1L, mFzd1L |
| 033S-G02 | hFzd1L | RSSQSLLHS NGYNYLD | 2136 | QGSNRAS | 2830 | CMQALQTPLTF | 3524 | hFzd1L, mFzd1L |
| 033S-H02 | hFzd1L | QASQDIRNY LN | 2137 | DASNLET | 2831 | CQQSYSVPYTF | 3525 | hFzd1L, mFzd1L |
| 033S-A03 | hFzd1L | RSSQSLLHS NGYNYLD | 2138 | AASTLQT | 2832 | CMQALQTPITF | 3526 | hFzd1L, mFzd1L |
| 033S-B03 | hFzd1L | RSSQSLLHS NGYNYLD | 2139 | LGSIRAS | 2833 | CMQALQTPLTF | 3527 | hFzd1L, mFzd1L |
| 034S-C01 | hFzd1L | RSSESLLHR NNGYYLD | 2140 | LGSNRAS | 2834 | CMQALQTPLTF | 3528 | hFzd1L, mFzd1L |
| 033S-E03 | hFzd1L | RSSQSLLHS NGYNYLD | 2141 | LGSNRAS | 2835 | CMQALQTPLTF | 3529 | hFzd1L, mFzd1L |
| 034S-E01 | hFzd1L | RSSQSLLHS NGYNYLD | 2142 | LGSNRAA | 2836 | CMQALQTPLTF | 3530 | hFzd1L, mFzd1L |
| 034S-F01 | hFzd1L | RSSQSLLHS NGYNYLD | 2143 | LGSHRAS | 2837 | CMQGLQTPLTF | 3531 | hFzd1L, mFzd1L |
| 034S-H01 | hFzd1L | RSSQSLLHS NGYNYLD | 2144 | LGSNRAS | 2838 | CMQAIQTPLTF | 3532 | hFzd1L, mFzd1L |
| 034S-A02 | hFzd1L | RSSQSLLHS NGYNYLD | 2145 | LGSNRAS | 2839 | CMQGLQTPITF | 3533 | hFzd1L, mFzd1L |
| 034S-B02 | hFzd1L | RSSQSLLHS NGYNYLD | 2146 | LGSNRAS | 2840 | CMQTIRTPITF | 3534 | hFzd1L, mFzd1L |
| 034S-C02 | hFzd1L | RSSQSLLHS NGYNYLD | 2147 | LGSNRAS | 2841 | CMQALQNPLTF | 3535 | hFzd1L, mFzd1L |
| 034S-E02 | hFzd1L | RSSZSLLHS NGYNYLD | 2148 | LGSNRAS | 2842 | CMQAIQTPLTF | 3536 | hFzd1L |
| 034S-F02 | hFzd1L | RSSQSLLHS NGYNYLD | 2149 | AASSLQS | 2843 | CMQAIQTPLTF | 3537 | hFzd1L |
| 037S-D01 | hFzd1L | RSSQSLLHS NGYNYLD | 2150 | MGSNRAS | 2844 | CMQALQTPLTF | 3538 | hFzd1L |
| 037S-E01 | hFzd1L | RSSQSLLNN NGNTYID | 2151 | LGSNRAS | 2845 | CMQTLKTPLSF | 3539 | hFzd1L |
| 037S-F01 | hFzd1L | QASQSIYNY LN | 2152 | GASSLHS | 2846 | CQQAISFPLTF | 3540 | hFzd1L |
| 037S-G01 | hFzd1L | RASQSISSW LA | 2153 | KASTLQS | 2847 | CQQSYSFPYTF | 3541 | hFzd1L |
| 037S-H01 | hFzd1L | RSSQSLLHS NGYNYLD | 2154 | LASNRAS | 2848 | CMQALQTPITF | 3542 | hFzd1L |
| 037S-A02 | hFzd1L | QASQDISND LN | 2155 | AASTLHS | 2849 | CQQTYSTPYTF | 3543 | hFzd1L |
| 037S-B02 | hFzd1L | RASQSINKW LA | 2156 | AASSLQS | 2850 | CQQGYTTPLTF | 3544 | hFzd1L |
| 032S-E01 | mFzd1L | RSSQSLLHS NGYNYLD | 2157 | LASNRAS | 2851 | CMQAVQVPITF | 3545 | hFzd1L, mFzd1L |

TABLE 2-continued

Clone IDs and CDR sequences for hinge specific ("L") or hinge (L) + CRD ("ext") binders. "CDRH" indicates heavy chain CDRs, and "CDRL" indicates light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 032S-E01 | mFzd1L | QASQDISNY LN | 2158 | AAAILQN | 2852 | CQQSYSTPLTF | 3546 | hFzd1L, mFzd1L |
| 032S-F01 | mFzd1L | QASQDIRNY LN | 2159 | GASNLQS | 2853 | CQQSYNTPFTF | 3547 | mFzd1L |
| 032S-C02 | mFzd1L | RSSQSLLHS NGYNYLD | 2160 | AASRLQS | 2854 | CMQGTHWPLTF | 3548 | mFzd1L |
| 032S-E02 | mFzd1L | RASQDISNY LN | 2161 | GATTLMS | 2855 | CQQSYSTPFTF | 3549 | mFzd1L |
| 032S-G02 | mFzd1L | RASQDISNY LN | 2162 | GATTLMS | 2856 | CQQSYSTPFTF | 3550 | mFzd1L |
| 031S-D01 | hFzd2ext | RASQGISNN LN | 2163 | AASSLQS | 2857 | CQQSYRTPLTF | 3551 | hFzd1L, 2L, 7L |
| 031S-E01 | hFzd2ext | RSSQTINZY LN | 2164 | AASSLZS | 2858 | CQQANSFPLTF | 3552 | hFzd1L, 2L, 7L |
| 031S-F01 | hFzd2ext | RASQSVSSY VN | 2165 | KASSLER | 2859 | CQQSYSPPLTF | 3553 | hFzd2L |
| 031S-G01 | hFzd2ext | RSSQSLLHS NGYNYLD | 2166 | LGSNRAS | 2860 | CMQALQTPLTF | 3554 | hFzd2L |
| 031S-B02 | hFzd2ext | RASQSVSGS YLA | 2167 | GASTRAT | 2861 | CQQYGSSPLTF | 3555 | hFzd2L |
| 034S-H02 | hFzd2L | RASQGISSW LA | 2168 | DATNLAT | 2862 | CQQTYSTPYTF | 3556 | hFzd2L |
| 034S-F03 | hFzd2L | RSSQSLLHS NGYNYLD | 2169 | AASSLQS | 2863 | CMQALQTPYTF | 3557 | hFzd2L |
| 034S-C09 | hFzd2L | RASERISQY LN | 2170 | AASSLQS | 2864 | CQQSHRLPWTF | 3558 | hFzd2L, mFzd2L |
| 034S-D09 | hFzd2L | ZZZQSVZGN YLZ | 2171 | GASTRAT | 2865 | CQQYHSYPLTF | 3559 | hFzd2L, mFzd2L |
| 034S-E09 | hFzd2L | RASQSVSSS YLZ | 2172 | GASTRAT | 2866 | CQQYGSSPLTF | 3560 | hFzd2L, mFzd2L |
| 034S-F09 | hFzd2L | RASQSVSSS YLA | 2173 | GASTRAT | 2867 | CQQYGSSPLTF | 3561 | hFzd2L, mFzd2L |
| 034S-A10 | hFzd2L | RSSQSLLHS NGYNYLD | 2174 | LGSNRAS | 2868 | CMQSLQNPITF | 3562 | hFzd2L, mFzd2L |
| 034S-D10 | hFzd2L | RSSQSLLHS NGYNYLD | 2175 | AASTLQS | 2869 | CMQGLQTPITF | 3563 | hFzd2L, mFzd2L |
| 034S-C11 | hFzd2L | RSSQSLLHS NGYNYLD | 2176 | AASSLQS | 2870 | CMQAIQTPITF | 3564 | hFzd2L, mFzd2L |
| 034S-C12 | hFzd2L | RSSQSLLHS NGYNYLD | 2177 | LGSNRAS | 2871 | CMQAIQTPITF | 3565 | mFzd2L |
| 034S-F12 | hFzd2L | RSSQSLLHS NGYNYLD | 2178 | KASSLEN | 2872 | CMQGSHWPPTF | 3566 | mFzd2L |
| 034S-G12 | hFzd2L | RSSQSZZHS NGYNYLD | 2179 | LGSNRAS | 2873 | CMQSIQNPITF | 3567 | mFzd2L |
| 035S-D01 | hFzd2L | RASQSVSSN YLA | 2180 | GASTRAT | 2874 | CQQYHSYPLTF | 3568 | mFzd2L |
| 036S-A01 | hFzd2L | | | | | | | hFzd2L, mFzd2L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 037S-C02 | hFzd2L | RASERISQY LN | 2181 | AASSLQS | 2875 | CQQSHRLPWTF | 3569 | hFzd2L |
| 037S-G02 | hFzd2L | RASQRVNTN YLA | 2182 | GASTRAT | 2876 | CQQYATSPLTF | 3570 | hFzd2L |
| 037S-A03 | hFzd2L | RZZQSLPPS NGYNYLD | 2183 | AASSLQS | 2877 | CMQATHWPYTF | 3571 | hFzd2L |
| 037S-C03 | hFzd2L | RSSQSLLYS NGYTYVD | 2184 | LGSNRAS | 2878 | CMQALQTPITF | 3572 | hFzd2L |
| 037S-D03 | hFzd2L | QASQDIRTD LH | 2185 | ATSSLQS | 2879 | CQQANSFPFTF | 3573 | hFzd2L |
| 037S-E03 | hFzd2L | RASERISQY LN | 2186 | AASSLQS | 2880 | CQQSHRLPWTF | 3574 | hFzd2L |
| 037S-H03 | hFzd2L | RSSQSLIHS NGYTYLD | 2187 | VASNWAS | 2881 | CMQALQTPLSF | 3575 | hFzd2L |
| 037S-B04 | hFzd2L | RSSQSLLYT NGLTYVD | 2188 | LGSNRAS | 2882 | CMQALQTPLTF | 3576 | hFzd2L |
| 037S-F04 | hFzd2L | | | | | | | hFzd2L |
| 037S-H04 | hFzd2L | RSSQSLIHS NGYNYLD | 2189 | AASTLQS | 2883 | CMQSIQLPLTF | 3577 | hFzd2L, mFzd2L |
| 037S-F05 | hFzd2L | RASQDIKND LG | 2190 | AASSLQS | 2884 | CLQSFSSPWTF | 3578 | hFzd2L |
| 048S-E01 | hFzd2L | RSSQSLLFT NGHNYLD | 2191 | LGSSRAS | 2885 | CMQALQTPLTF | 3579 | hFzd2L |
| 048S-C01 | hFzd2L | RSSQSLLHS NGYNYLD | 2192 | LGSNRAS | 2886 | CMQGTHWPPTF | 3580 | hFzd2L |
| 048S-G01 | hFzd2L | RSSQSLZHS NGYKYLD | 2193 | LGSHRPS | 2887 | CMQALQTPITF | 3581 | hFzd2L |
| 048S-D01 | hFzd2L | RSSQSLLHS NGYNYLD | 2194 | LGSHRAS | 2888 | CMQALQTPITF | 3582 | hFzd2L |
| 048S-B02 | hFzd2L | RASERISQY LN | 2195 | AASSLQS | 2889 | CQQSHRLPWTF | 3583 | hFzd2L |
| 048S-F01 | hFzd2L | RSSQSLLHS NGYNYLD | 2196 | LGSNRAS | 2890 | CMQALQTPLTF | 3584 | hFzd2L |
| 048S-H01 | hFzd2L | RASQSVSSS YLA | 2197 | GASTRAT | 2891 | CQQYYSNPLTF | 3585 | hFzd2L |
| 048S-A02 | hFzd2L | RASQGISSY LN | 2198 | GSTNLQN | 2892 | CQQVNSLPITF | 3586 | hFzd2L |
| 048S-C02 | hFzd2L | RSSQSLLHS NGYNYLD | 2199 | LGSNRAS | 2893 | CMQALETPLTF | 3587 | hFzd2L |
| 048S-E02 | hFzd2L | KSSQSVLYS SNNKNYLA | 2200 | WASTRES | 2894 | CHQYYSTPLTF | 3588 | hFzd2L |
| 048S-A01 | hFzd2L | RSSQSLLHS NGYNYLD | 2201 | AASSLQS | 2895 | CMQALQTPYTF | 3589 | hFzd2L, mFzd2L |
| 049S-A01 | hFzd2L | RASQSVSSS YLA | 2202 | GASTRAT | 2896 | CQQYGSSPLTF | 3590 | hFzd2L, mFzd2L |
| 049S-C01 | hFzd2L | RSSQSLLHS NGYNYLD | 2203 | LGSNRAS | 2897 | CMQALEIPVTF | 3591 | hFzd2L, mFzd2L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 049S-D01 | hFzd2L | RASQGISNY LN | 2204 | AASSLQS | 2898 | CQQSYFTPLTF | 3592 | hFzd2L, mFzd2L |
| 049S-E01 | hFzd2L | RSSQSLLHS NGYNYLD | 2205 | LGSNRAS | 2899 | CMQSLQNPITF | 3593 | hFzd2L, mFzd2L |
| 044S-G10 | mFzd3L | RASQSISSY LN | 2206 | AASTLQG | 2900 | CQQSYSVPfTF | 3594 | hFzd3L, hFzd6L |
| 044S-H10 | mFzd3L | RASQTITSN YLA | 2207 | GASTRAT | 2901 | CQQYGSLPIAF | 3595 | mFzd3L |
| 044S-A11 | mFzd3L | RASQSISSY LN | 2208 | KASSLES | 2902 | CQQTNSFPITF | 3596 | mFzd3L |
| 044S-B11 | mFzd3L | RSSQSLLHS NGYNYLD | 2209 | LSSNRAS | 2903 | CMQALQTPITF | 3597 | hFzd3L, mFzd3L |
| 044S-C11 | mFzd3L | RSSQSLLHS NGYNYLD | 2210 | YASQSIS | 2904 | CMQATQFPWTF | 3598 | hFzd3L, hFzd6L |
| 044S-E11 | mFzd3L | KSSQSVLYT SNNKNYLA | 2211 | ZASTRES | 2905 | CQQYYRTPITF | 3599 | hFzd3L, hFzd6L |
| 044S-F11 | mFzd3L | QASQNZZTF LN | 2212 | DASNLET | 2906 | CQQSYSTPLTF | 3600 | hFzd3L, mFzd3L |
| 044S-G11 | mFzd3L | QASQDISNY LN | 2213 | DASNLET | 2907 | CQQTYSSPWTF | 3601 | hFzd3L, mFzd3L |
| 044S-H11 | mFzd3L | RASQNIDKW LA | 2214 | AASZZQS | 2908 | CQQSYNTPFTF | 3602 | hFzd3L, mFzd3L |
| 044S-B12 | mFzd3L | RASQGISNY LA | 2215 | AASSLQS | 2909 | CQQSYSTPLTF | 3603 | hFzd3L, mFzd3L |
| 044S-C12 | mFzd3L | RASQTVGTT YLA | 2216 | AASSRAA | 2910 | CQQRSNWPPSI TF | 3604 | hFzd3L, mFzd3L |
| 044S-D12 | mFzd3L | RSSQSLLHS NGYNYLD | 2217 | LGSNRAS | 2911 | CMQGSHWPLTF | 3605 | hFzd3L, hFzd6L |
| 044S-E12 | mFzd3L | RASQRIGTY LN | 2218 | ATSSLHT | 2912 | CQQSYSTPFTF | 3606 | hFzd3L, mFzd3L |
| 044S-F12 | mFzd3L | KSSQSVLYS SNNKNYLA | 2219 | WASTRES | 2913 | CQQYYSSPITF | 3607 | hFzd3L, hFzd6L |
| 045S-A01 | mFzd3L | RASQGISSW LA | 2220 | AASSLQS | 2914 | CQQSYSPPYTF | 3608 | hFzd3L, mFzd3L |
| 045S-B01 | mFzd3L | QASQDIRKY LN | 2221 | AASTLQS | 2915 | CQQSYSTPPTF | 3609 | hFzd3L, hFzd6L |
| 045S-C01 | mFzd3L | RASQSISRY LH | 2222 | GASNLET | 2916 | CQQANTSPITF | 3610 | hFzd3L, mFzd3L |
| 045S-D01 | mFzd3L | RSSQSLLHS NGYNYLD | 2223 | AASSLQS | 2917 | CMQGAHWPPTF | 3611 | hFzd3L, mFzd3L |
| 045S-E01 | mFzd3L | KSSQSVLYS SNNKNYLA | 2224 | WASTRES | 2918 | CQQYFSSPITF | 3612 | hFzd3L, mFzd3L |
| 045S-G01 | mFzd3L | RASQSISSH LN | 2225 | AASTLQS | 2919 | CQQSYSTPLTF | 3613 | hFzd3L, mFzd3L |
| 045S-H01 | mFzd3L | RASQSISSY LN | 2226 | AASSLHS | 2920 | CQQANSFPITF | 3614 | hFzd3L, mFzd3L |
| 045S-A02 | mFzd3L | QASQDINNY LN | 2227 | AASTLQS | 2921 | CQQSYTTPITF | 3615 | hFzd3L, mFzd3L |

TABLE 2-continued

Clone IDs and CDR sequences for hinge specific ("L") or hinge (L) + CRD ("ext") binders. "CDRH" indicates heavy chain CDRs, and "CDRL" indicates light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 045S-B02 | mFzd3L | RASQNIKRY LN | 2228 | AASSLQS | 2922 | CQQSHSSPVTF | 3616 | hFzd3L, mFzd3L |
| 045S-D02 | mFzd3L | RASQSISNN LN | 2229 | ASSRLQT | 2923 | CQQSYTIPITF | 3617 | hFzd3L, mFzd3L |
| 045S-E02 | mFzd3L | RASQSIGSY LN | 2230 | AASSLQS | 2924 | CQQANSFPLSF | 3618 | hFzd3L, mFzd3L |
| 045S-F02 | mFzd3L | QASQDISNY LN | 2231 | DASNLET | 2925 | CQQSFSIPLTF | 3619 | hFzd3L, mFzd3L |
| 045S-G02 | mFzd3L | KSSQSVFYN SNNKNYLA | 2232 | WASTRAY | 2926 | CQQFYSTPITF | 3620 | hFzd3L, mFzd3L |
| 045S-H02 | mFzd3L | RASQGIGNY LA | 2233 | AASSLQS | 2927 | CQQSYSTPFTF | 3621 | hFzd3L, mFzd3L |
| 045S-A03 | mFzd3L | RSSQSLLHS NGYNYLD | 2234 | LGSNRAS | 2928 | CMQSLQAPITF | 3622 | hFzd3L, mFzd3L |
| 045S-B03 | mFzd3L | RSSQSLLHS NGYNYVD | 2235 | LGSNRAS | 2929 | CMQGTHWPITF | 3623 | hFzd3L, mFzd3L |
| 045S-C03 | mFzd3L | RASQSISSY LN | 2236 | AASSLQS | 2930 | CQQSYSTPLTF | 3624 | hFzd3L, mFzd3L |
| 045S-D03 | mFzd3L | QASQDISNY LN | 2237 | AASNLQS | 2931 | CQQTYRNPITF | 3625 | hFzd3L, mFzd3L |
| 045S-F03 | mFzd3L | RASQAINSY LA | 2238 | DATNLKT | 2932 | CQQSYSTPLTF | 3626 | hFzd3L, mFzd3L |
| 045S-G03 | mFzd3L | RSSQSLLHS NGYNYLD | 2239 | LGSNRAS | 2933 | CMQALQTPLTF | 3627 | hFzd3L, mFzd3L |
| 045S-H03 | mFzd3L | KSSQSVLYS SNNKNYLA | 2240 | WASTRQS | 2934 | CQQYYGSPITF | 3628 | hFzd3L, mFzd3L |
| 045S-A04 | mFzd3L | RASQGISNY LA | 2241 | GASSLOG | 2935 | CQQSYRTVTF | 3629 | hFzd3L, hFzd6L |
| 045S-B04 | mFzd3L | RASQSISSY LN | 2242 | KASSLES | 2936 | CQQANSFPLTF | 3630 | hFzd3L, mFzd3L |
| 045S-D04 | mFzd3L | RSSQSLLHS NGYNYLD | 2243 | AASNLQS | 2937 | CMQGLQTPWTF | 3631 | hFzd3L, mFzd3L |
| 045S-E04 | mFzd3L | RASQGIRND LG | 2244 | AASSLQS | 2938 | CQQSYSTPYTF | 3632 | hFzd3L, mFzd3L |
| 045S-F04 | mFzd3L | RASQHINRY LN | 2245 | GASNLET | 2939 | CQQSYSYPITF | 3633 | hFzd3L, mFzd3L |
| 045S-G04 | mFzd3L | RASQGISSW LA | 2246 | AASTLQS | 2940 | CQQTWGPPFTF | 3634 | hFzd3L, mFzd3L |
| 045S-H04 | mFzd3L | RSSQSLLHS NGYNYLD | 2247 | LGSNRAS | 2941 | CMQALQTPITF | 3635 | hFzd3L, mFzd3L |
| 045S-A05 | mFzd3L | QASQDISNY LN | 2248 | AASTLQS | 2942 | CQQTYATPPTF | 3636 | hFzd3L, mFzd3L |
| 04SS-B05 | mFzd3L | RSSQSLLHS NGYNYLD | 2249 | LGSNRAS | 2943 | CMQAIQTPLTF | 3637 | hFzd3L, mFzd3L |
| 04SS-C05 | mFzd3L | RASQTISDY LN | 2250 | KASTLGS | 2944 | CQQANTFPYTF | 3638 | hFzd3L, mFzd3L |
| 04SS-D05 | mFzd3L | RSSQSLLHS NGYNYLD | 2251 | LGSNRAS | 2945 | CMQALQTPLTF | 3639 | hFzd3L, mFzd3L |

TABLE 2-continued

Clone IDs and CDR sequences for hinge specific ("L") or hinge (L) + CRD ("ext") binders. "CDRH" indicates heavy chain CDRs, and "CDRL" indicates light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|----------|---------|-------|--------------|-------|--------------|-------|--------------|-------------------|
| 04SS-E05 | mFzd3L | RASQGIRSD LG | 2252 | KASSLES | 2946 | CQQSYTIPITF | 3640 | hFzd3L, mFzd3L |
| 045S-F05 | mFzd3L | RSSQSLLHS NGYNYLD | 2253 | AASSLQS | 2947 | CMQALQTPYTF | 3641 | hFzd3L, mFzd3L |
| 045S-G05 | mFzd3L | RASQSISSY LN | 2254 | DASNLET | 2948 | CQQSLSTPITF | 3642 | hFzd3L, mFzd3L |
| 045S-A06 | mFzd3L | RASLSVTNN YLA | 2255 | GASTRAT | 2949 | CHQYGNFPLTF | 3643 | hFzd3L, mFzd3L |
| 045S-B06 | mFzd3L | RSSQSLLHS NGYNYLD | 2256 | AASSLQS | 2950 | CMQGTQWPLTF | 3644 | hFzd3L, mFzd3L |
| 045S-C06 | mFzd3L | RASQGISSY LA | 2257 | AASSLQS | 2951 | CQQSYSTPLTF | 3645 | hFzd3L, mFzd3L |
| 045S-D06 | mFzd3L | RASQSISSY LN | 2258 | AASSLQS | 2952 | CQQSYSTPLTF | 3646 | hFzd3L, mFzd3L |
| 045S-E06 | mFzd3L | RASQSISSY LN | 2259 | AASSLQS | 2953 | CQQSYSTPLTF | 3647 | hFzd3L, mFzd3L |
| 045S-G06 | mFzd3L | QASQDISNY LN | 2260 | SASTLQS | 2954 | CQQTYSIPITF | 3648 | hFzd3L, mFzd3L |
| 045S-H06 | mFzd3L | RASQSISSY LN | 2261 | AASSLQS | 2955 | CQQSYTTPITF | 3649 | hFzd3L, mFzd3L |
| 045S-A07 | mFzd3L | RASQDISNY LN | 2262 | AASILQS | 2956 | CQQTYSIPITF | 3650 | mFzd3L |
| 045S-C07 | mFzd3L | RASQGISNY LA | 2263 | QASTSQS | 2957 | CQQSDSPPFTF | 3651 | hFzd3L, mFzd3L |
| 044S-D01 | hFzd3L | RASQSISKW LA | 2264 | GASTLQA | 2958 | CQQYNSYWTF | 3652 | hFzd3L, mFzd3L |
| 044S-E01 | hFzd3L | KSSQSVLYS SNNKNYLA | 2265 | WASTRES | 2959 | CQQYYSTPWTF | 3653 | hFzd3L, mFzd3L |
| 044S-F01 | hFzd3L | RASQSISSY LN | 2266 | NASSLQS | 2960 | CQQGYSAPFTF | 3654 | hFzd3L, mFzd3L |
| 044S-G01 | hFzd3L | QASQGINNY LN | 2267 | DASTLES | 2961 | CQQAKSFPLTF | 3655 | hFzd3L, mFzd3L |
| 044S-A02 | hFzd3L | RASQNIGSY LN | 2268 | AASSLQT | 2962 | CQQSYSPPLTF | 3656 | hFzd3L, mFzd3L |
| 044S-B02 | hFzd3L | RASQNIGSW LA | 2269 | AASSLQS | 2963 | CQQSYSTPLTF | 3657 | hFzd3L, mFzd3L |
| 044S-C02 | hFzd3L | QASQDISNY LN | 2270 | DASNLET | 2964 | CQRADSFPLTF | 3658 | hFzd3L, mFzd3L |
| 044S-D02 | hFzd3L | RSSQSLLHS NGYNYLD | 2271 | LGSNRAS | 2965 | CKQALQTPITF | 3659 | hFzd3L, mFzd3L |
| 044S-E02 | hFzd3L | RSSQSLLHS NGYNYLD | 2272 | AASSLQS | 2966 | CMQALQAPYTF | 3660 | hFzd3L, mFzd3L |
| 044S-F02 | hFzd3L | RSSQSLLHS NGYNYLD | 2273 | LGSNRAS | 2967 | CMQSLQTPLTF | 3661 | hFzd3L, mFzd3L |
| 044SH02 | hFzd3L | RASQSISRW LA | 2274 | KASSLES | 2968 | CQQYYNAPPTF | 3662 | hFzd3L, hFzd6L |
| 044S-B03 | hFzd3L | RASQGISNY LA | 2275 | KASSLES | 2969 | CQQNYSFPFTF | 3663 | hFzd3L, hFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 044S-C03 | hFzd3L | RASQSVSSS YLA | 2276 | CASTRAT | 2970 | CQQYGHLPVSF | 3664 | hFzd3L, hFzd6L |
| 044S-D03 | hFzd3L | RASQYISNY LN | 2277 | AASSLQS | 2971 | CQQSYSAPYTF | 3665 | hFzd3L, mFzd3L |
| 044S-E03 | hFzd3L | RASQDISNY LN | 2278 | AASNLET | 2972 | CQQANSFPLTF | 3666 | hFzd3L, mFzd3L |
| 044S-F03 | hFzd3L | RSSQSLLHS NGYNYLD | 2279 | LGSNRAS | 2973 | CMQGTHLPPTF | 3667 | hFzd3L, hFzd6L |
| 044S-G03 | hFzd3L | RASQSISRW LA | 2280 | TASTLQS | 2974 | CQQANSFPPTF | 3668 | hFzd3L, mFzd3L |
| 044S-A04 | hFzd3L | RASQSISTY LN | 2281 | TASNLQT | 2975 | CQQTYSLPWTF | 3669 | hFzd3L, mFzd3L |
| 044S-C04 | hFzd3L | RASQNINSY LH | 2282 | AASHLQS | 2976 | CQQANTFPITF | 3670 | hFzd3L, hFzd6L |
| 044S-D04 | hFzd3L | RSSQSLLHS NGYNYLD | 2283 | LGSSRAS | 2977 | CMQALQTPFTF | 3671 | hFzd3L, hFzd6L |
| 044S-A01 | hFzd3L | RASQDISNY LN | 2284 | QASTLER | 2978 | CQQSYSTPFTF | 3672 | hFzd3L |
| 044S-B01 | hFzd3L | RASQDIRSD LG | 2285 | AASTLQS | 2979 | CQQANSFPSF | 3673 | mFzd3L |
| 044S-C01 | hFzd3L | RASQYISNY LN | 2286 | AASTLQS | 2980 | CQQADRLPLTF | 3674 | mFzd3L |
| 044S-G02 | hFzd3L | RASQSISRW LA | 2287 | TASTLQS | 2981 | CQQANSFPPTF | 3675 | hFzd3L, mFzd3L |
| 044S-H03 | hFzd3L | KSSQSVLYS SNNKNYLA | 2288 | WASTRES | 2982 | CQQYYSSPLTF | 3676 | mFzd3L |
| 044S-B04 | hFzd3L | QASQDISNY LN | 2289 | RASSLQS | 2983 | CQQANSFPPTF | 3677 | mFzd3L |
| 044S-G04 | hFzd3L | QASQDISNY LN | 2290 | AASTLQS | 2984 | CQQTNSFPPTF | 3678 | mFzd3L |
| 044S-H04 | hFzd3L | RASQSINNW LA | 2291 | DASNLQT | 2985 | CQQRYSTPLTF | 3679 | hFzd3L, mFzd3L |
| 044S-A05 | hFzd3L | RASQSISSY LN | 2292 | AASSLQS | 2986 | CQQSYSTPLTF | 3680 | hFzd3L, mFzd3L |
| 044S-B05 | hFzd3L | RASQSIZSY LN | 2293 | AASTLRS | 2987 | CQQSYSTPPTF | 3681 | mFzd3L |
| 044S-C05 | hFzd3L | RASQSISSY LN | 2294 | TASSLQS | 2988 | CQQSYSVPLTF | 3682 | hFzd3L, mFzd3L |
| 044S-D05 | hFzd3L | KSSRSVLNS SNNKNYLA | 2295 | WASTRAS | 2989 | CQQYYSSPYTF | 3683 | hFzd3L, hFzd6L |
| 044S-E05 | hFzd3L | RSSQSLLHS NGYNYLD | 2296 | SGSSRAS | 2990 | CMQALQTPITF | 3684 | hFzd3L, mFzd3L |
| 044S-G05 | hFzd3L | RASQSISVY LN | 2297 | DASKLQS | 2991 | CQQSFNTPWTF | 3685 | hFzd3L, hFzd6L |
| 044S-H05 | hFzd3L | RASQSISSY LN | 2298 | AASSLQS | 2992 | CQQSYSTPLTF | 3686 | hFzd3L, mFzd3L |
| 044S-A06 | hFzd3L | RSSQSLLHS NGYNYLD | 2299 | LGSNRAS | 2993 | CMQSTHWPPTF | 3687 | hFzd3L, mFzd3L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 044S-B06 | hFzd3L | RASQSINRY LN | 2300 | GASSLQS | 2994 | CQQTNSFPPTF | 3688 | hFzd3L, mFzd3L |
| 044S-C06 | hFzd3L | RASQSISRH LT | 2301 | AASSLHT | 2995 | CQQSYSTPYTF | 3689 | hFzd3L, mFzd3L |
| 044S-D06 | hFzd3L | RASQSISTY LN | 2302 | SASNLQS | 2996 | CQQSDSPPVTF | 3690 | hFzd3L, mFzd3L |
| 044S-E06 | hFzd3L | RASQGIGTW LA | 2303 | AASTLQS | 2997 | CQQSYSTPFTF | 3691 | hFzd3L, mFzd3L |
| 044S-F06 | hFzd3L | RASQSINKW LA | 2304 | AASTLQS | 2998 | CQQANSLPFTF | 3692 | hFzd3L, mFzd3L |
| 044S-G06 | hFzd3L | RSSQSLLHS NGYNYLD | 2305 | LGSYRAS | 2999 | CMQALQTPTF | 3693 | hFzd3L, mFzd3L |
| 044S-H06 | hFzd3L | KSSQSVLYS SNNKNYLA | 2306 | WASTRES | 3000 | CQQYYTTPITF | 3694 | hFzd3L, mFzd3L |
| 044S-A07 | hFzd3L | KSSQSVLYR SNNKNYLA | 2307 | WASTRES | 3001 | CQQYFSVPFTF | 3695 | hFzd3L, mFzd3L |
| 044S-B07 | hFzd3L | QASQDISNY LN | 2308 | KASSLES | 3002 | CQQSYSTPITF | 3696 | hFzd3L, mFzd3L |
| 044S-C07 | hFzd3L | QASQDISNY LN | 2309 | AASTLQS | 3003 | CQQANSFPITF | 3697 | hFzd3L, mFzd3L |
| 044S-D07 | hFzd3L | RSSQSLLHS NGYNYLD | 2310 | LGSNRAS | 3004 | CMQALQAPTF | 3698 | hFzd3L, mFzd3L |
| 044S-E07 | hFzd3L | RSSQSLLHS NGYNYLD | 2311 | AASSLQS | 3005 | CMQALQTPITF | 3699 | hFzd3L, mFzd3L |
| 044S-F07 | hFzd3L | QASQDITNY LN | 2312 | KASSLES | 3006 | CQQANSFPVTF | 3700 | hFzd3L, mFzd3L |
| 044S-G07 | hFzd3L | RSSQSLLHZ ZZYNYLD | 2313 | AASALQS | 3007 | CMQARQTPITF | 3701 | mFzd3L |
| 044S-H07 | hFzd3L | RASQNISNY LN | 2314 | KASSLES | 3008 | CQESYTTPFTF | 3702 | hFzd3L, mFzd3L |
| 044S-A08 | hFzd3L | RSSQSLLHS NGYNYLD | 2315 | LGSNRAS | 3009 | CMQALQTPLTF | 3703 | hFzd3L, mFzd3L |
| 044S-B08 | hFzd3L | RASQSVSRW LA | 2316 | DASNLET | 3010 | CQQTYNPPLTF | 3704 | mFzd3L |
| 044S-C05 | hFzd3L | RSSQSLLHS NGYNYLD | 2317 | LGSNRAS | 3011 | CMQALQNPLTF | 3705 | hFzd3L, mFzd3L |
| 044S-E08 | hFzd3L | RASQTIDNY LQ | 2318 | AASSLQS | 3012 | CQQSYITPYTF | 3706 | hFzd3L, mFzd3L |
| 044S-F08 | hFzd3L | RASQSVSSS YLS | 2319 | ATSSRAA | 3013 | CQQRSNWPPTI TF | 3707 | hFzd3L, mFzd3L |
| 044S-G08 | hFzd3L | RASQSISNW LA | 2320 | AASILQR | 3014 | CQQSYSPPTTF | 3708 | hFzd3L, mFzd3L |
| 044S-A09 | hFzd3L | RASQSISSY LN | 2321 | KASTLES | 3015 | CQQSYKSPLTF | 3709 | hFzd3L, mFzd3L |
| 044S-B09 | hFzd3L | RSSQSLLHS NGYNYLD | 2322 | LGSNRAS | 3016 | CMQGLQTPTF | 3710 | hFzd3L, mFzd3L |
| 044S-C09 | hFzd3L | RASQAIRND LG | 2323 | AASSLQS | 3017 | CQQGYNPPRTF | 3711 | hFzd3L, mFzd3L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|----------|---------|-------|------|-------|------|-------|------|-----------|
| 044S-E09 | hFzd3L | RASQGISNY LA | 2324 | DASNLET | 3018 | CQQSYSPPYTF | 3712 | hFzd3L, mFzd3L |
| 044S-F09 | hFzd3L | RVSQGISSY LN | 2325 | AASSLQS | 3019 | CQQSYTLPITF | 3713 | hFzd3L, hFzd6L |
| 044S-G09 | hFzd3L | RASQSISSY LN | 2326 | GASTLQS | 3020 | CQQSYSTPFTF | 3714 | hFzd3L, mFzd3L |
| 044S-H09 | hFzd3L | RASQSISSY LN | 2327 | RASSLQG | 3021 | CQQSYSTPYTF | 3715 | hFzd3L, hFzd6L |
| 044S-A10 | hFzd3L | RSSQSLLHS NGYNYLD | 2328 | LGSYRAS | 3022 | CMQGTHWPPAF | 3716 | hFzd3L, mFzd3L |
| 044S-B10 | hFzd3L | RASQSISTW LA | 2329 | AASSLQS | 3023 | CQQSYNTPfTF | 3717 | hFzd3L, mFzd3L |
| 044S-D10 | hFzd3L | RASQSVSSN LA | 2330 | GASTRAT | 3024 | CQQYKSYPLTF | 3718 | hFzd3L, mFzd3L |
| 038S-B01 | hFzd4L | RSSQSLZHS NGYNYLD | 2331 | LGSHRAS | 3025 | CMQAIQIPYSF | 3719 | hFzd4L |
| 038S-D01 | hFzd4L | RASZSIZSW LA | 2332 | AASSLQS | 3026 | CQQANSFPLTF | 3720 | hFzd4L |
| 038S-D03 | hFzd4L | RASQGIGNF LA | 2333 | AASSLQS | 3027 | CQQANSFPLTF | 3721 | hFzd4L |
| 038S-E02 | hFzd4L | RASQGISSW LA | 2334 | GSSRLPS | 3028 | CQQSYNIPLTF | 3722 | hFzd4L |
| 038S-E03 | hFzd4L | RSSQSLLHS NGYNYLD | 2335 | LGSNRAS | 3029 | CMQALRTPVTF | 3723 | hFzd4L |
| 038S-E05 | hFzd4L | RSSRSLLYT NGLTYID | 2336 | LGSNRAS | 3030 | CMQALQTPLTF | 3724 | hFzd4L |
| 038S-A04 | hFzd4L | RSSQSLLHS NGYNYLD | 2337 | LGSNRAS | 3031 | CMQGLQTPVTF | 3725 | hFzd4L |
| 038S-D04 | hFzd4L | RSIQSLLHS NGYKYLD | 2338 | TASTLQT | 3032 | CKQANQTPITF | 3726 | hFzd4L |
| 038S-E01 | hFzd4L | RSSQSRASQ NIZNYLA | 2339 | VASNLES | 3033 | CKQGDQIPPTF | 3727 | hFzd4L |
| 038S-C08 | hFzd4L | RASQSISTW LA | 2340 | GASVLQS | 3034 | CQQSYSTPLTF | 3728 | hFzd4L |
| 038S-A03 | hFzd4L | RASQGISNY LA | 2341 | DASSLQG | 3035 | CQQSYSEVLTF | 3729 | hFzd4L |
| 039S-B03 | hFzd4L | RASQDIGNE LG | 2342 | AASNLQA | 3036 | CQQSYTAPLTF | 3730 | hFzd4L |
| 038S-B02 | hFzd4L | QASQDISNY LN | 2343 | AASTLQS | 3037 | CQQSHSLPYTF | 3731 | hFzd4L |
| 038S-G03 | hFzd4L | RASQGIGNF LA | 2344 | AASNWQS | 3038 | CQQANSFPF7F | 3732 | hFzd4L |
| 039S-B06 | hFzd4L | RASQDIRTN LA | 2345 | AASSLQS | 3039 | CQQSYSLPWTF | 3733 | hFzd4L |
| 038S-C02 | hFzd4L | RASQNINTY LN | 2346 | AASSLQS | 3040 | CQQYDSYPLTF | 3734 | hFzd4L |
| 039S-B02 | hFzd4L | RSSRSLLHK NGHTYVE | 2347 | LGSNRAS | 3041 | CMQSLQTPLTF | 3735 | hFzd4L |

TABLE 2-continued

Clone IDs and CDR sequences for hinge specific ("L") or hinge (L) + CRD ("ext") binders. "CDRH" indicates heavy chain CDRs, and "CDRL" indicates light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 038S-B04 | hFzd4L | RASQSISSR LA | 2348 | SASNLET | 3042 | CQQTYHTPWTF | 3736 | hFzd4L |
| 039S-G02 | hFzd4L | QASQDISNY LN | 2349 | AASTLQT | 3043 | CQQSYSTPWTF | 3737 | hFzd4L |
| 039S-F04 | hFzd4L | RSSQSLLHS NGYNYLD | 2350 | AASSLQS | 3044 | CMQGLQTPHTF | 3738 | hFzd4L |
| 038S B08 | hFzd4L | RSSQSLLHS NGYNYLD | 2351 | TASTLZS | 3045 | CMQGLQTPHTF | 3739 | hFzd4L |
| 038S-C10 | hFzd4L | RASQGINNY LA | 2352 | GASNLET | 3046 | CQQSNTFPLTF | 3740 | hFzd4L |
| 038S-F06 | hF7d4L | YTFSSYYMH | 2353 | GWZNPNG GNTZYA | 3047 | CARDGSLDYW | 3741 | hFzd4L |
| 038S-F07 | hFzd4L | RASQDIRNY LA | 2354 | AASSLQS | 3048 | CQQAYSSPLTF | 3742 | hFzd4L |
| 038S-H06 | hFzd4L | RSSQSLLHS NGYNYLD | 2355 | AASTLQS | 3049 | CMQALQTPYTF | 3743 | hFzd4L |
| 038S-G07 | hFzd4L | RASZDIRNY LA | 2356 | AASSLQS | 3050 | CQQAYSSPLTF | 3744 | hFzd4L |
| 038S-F12 | hFzd4L | RSSQSLLHS NGYNYLD | 2357 | LGSNRAS | 3051 | CMQGLQTPHTF | 3745 | hFzd4L |
| 038S-B07 | hFzd4L | KSSRSVLYS SNKKNYLA | 2358 | ZZSTRES | 3052 | CQQYYSSPLTF | 3746 | hFzd4L |
| 039S-B04 | hFzd4L | RASQGISSS LA | 2359 | AASNLQS | 3053 | CQQSYSTPWTF | 3747 | hFzd4L |
| 039S-C02 | hFzd4L | RASQGISNN LN | 2360 | RASILQS | 3054 | CQQSYSTPITF | 3748 | hFzd4L |
| 039S-H05 | hFzd4L | RSSQSLLHS NGYNYLD | 2361 | LGSNRAS | 3055 | CMQALQTPLTF | 3749 | hFzd4L |
| 039S-G01 | hFzd4L | RASQSISTW LA | 2362 | AASSLQS | 3056 | CQQAKSFPYTF | 3750 | hFzd4L |
| 039S-E03 | hFzd4L | RSSQSLLHS NGYNYLD | 2363 | LGTNRAS | 3057 | CMQALQAPTTF | 3751 | hFzd4L |
| 039S-C01 | hFzd4L | RSSQSLLHS NGYNYLD | 2364 | AASSLQS | 3058 | CMQALQTPHTF | 3752 | hFzd4L |
| 039S-F02 | hFzd4L | RASQGISTW LS | 2365 | SASZLQS | 3059 | CQQANSFPLTF | 3753 | hFzd4L |
| 039S-E04 | hFzd4L | RSSQSLLHS NGYNYLD | 2366 | LASNRAS | 3060 | CMQALQTPYTF | 3754 | hFzd4L |
| 039S-C05 | hFzd4L | RASQSISSY LN | 2367 | AASSLQS | 3061 | CQQSYSTPLTF | 3755 | hFzd4L |
| 039S-F06 | hFzd4L | QASQSISTH LN | 2368 | AASSLQS | 3062 | CQQSFSIPWTF | 3756 | hFzd4L |
| 039S-A07 | hFzd4L | RASQSVGTW LA | 2369 | AASSLQS | 3063 | CQQSYSSPYTF | 3757 | hFzd4L |
| 039S-E10 | hFzd4L | RSSQSLLHS NGYNYLD | 2370 | LGSNRAS | 3064 | CRQALQIPYTF | 3758 | hFzd4L |
| 039S-G07 | hFzd4L | RSGRPIADY LS | 2371 | KASSLGS | 3065 | CQQAYSFPWTF | 3759 | hFzd4L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 039S-A10 | hFzd4L | RSSQSLLHS NGYNYLD | 2372 | AASSLQS | 3066 | CMQALQTPYTF | 3760 | hFzd4L |
| 039S-B07 | hFzd4L | RSSQSLLHS NGYNYLD | 2373 | LGSNRAS | 3067 | CMQALQTPATF | 3761 | hFzd4L |
| 039S-B09 | hFzd4L | RSSQSLLHS NGYNYLD | 2374 | LGSNRAS | 3068 | CMQALQTPHTF | 3762 | hFzd4L |
| 039S-A08 | hFzd4L | RZSQGIGNF LA | 2375 | AASSLQS | 3069 | CQQANSLPLTF | 3763 | hFzd4L |
| 039S-C09 | hFzd4L | RSSQSLLHS NGYNYLD | 2376 | AASSLQS | 3070 | CMQALQTPHTF | 3764 | hFzd4L |
| 039S-E07 | hFzd4L | RASQSISRW LA | 2377 | GASSLQR | 3071 | CQQADSFPYTF | 3765 | hFzd4L |
| 039S-H09 | hFzd4L | RSSQSLLHS NGYNYLD | 2378 | LGSNRAS | 3072 | CMQALQTPPTF | 3766 | hFzd4L |
| 040S-B01 | hFzd4L | RSSQSLLHS NGYNYLD | 2379 | LGSNRAS | 3073 | CMQALHTPNTF | 3767 | hFzd4L |
| 040S-A02 | hFzd4L | RSSQSLLHS NGYNYLD | 2380 | XGSNRAS | 3074 | CMQALQTPLTF | 3768 | hFzd4L |
| 040S-H04 | hFzd4L | KSSQSLLHS DGKTYLY | 2381 | KISNRFS | 3075 | CMQATQFPYTF | 3769 | hFzd4L |
| 040S E05 | hFzd4L | RSSQSLLHS NGYNYLD | 2382 | LGSNRAS | 3076 | CMQALQTPRTF | 3770 | hFzd4L |
| 039S-H10 | hFzd4L | RSSQSLLHS NGYNYLD | 2383 | AASSLQS | 3077 | CMQALQTPYTF | 3771 | hFzd4L |
| 040S-B02 | hFzd4L | KSSRSVLYS SNKKNYLA | 2384 | WASTRES | 3078 | CQQYYSSPLTF | 3772 | hFzd4L |
| 040S-C02 | hFzd4L | RSSQSLLHS NGYNYLD | 2385 | LGSNRAS | 3079 | CMQALQTPYTF | 3773 | hFzd4L |
| 040S-A05 | hFzd4L | RSSRSLLYS NGYNYLD | 2386 | LZSHRAS | 3080 | CMQALQTPYTF | 3774 | hFzd4L |
| 039S-C12 | hFzd4L | RSSQSLLHS NGYNYLD | 2387 | LGSNRAS | 3081 | CMQALQTPITF | 3775 | hFzd4L |
| 039S-F12 | hFzd4L | RASQGIGNF LA | 2388 | AASSLQS | 3082 | CQQANSLPLTF | 3776 | hFzd4L |
| 040S-E01 | hFzd4L | RSSQSLLHS NGYNYLD | 2389 | LGSNRAS | 3083 | CMQALQTPPTF | 3777 | hFzd4L |
| 040S-E02 | hFzd4L | RSSQSLLHS NGYNYLD | 2390 | LGSHRAS | 3084 | CMQALQTPYSF | 3778 | hFzd4L |
| 039S-F11 | hFzd4L | RSSQSLLHS NGYNYLD | 2391 | AASSLQS | 3085 | CMQALQTPITF | 3779 | hFzd4L |
| 040S-F01 | hFzd4L | RSSQSLLHS NGYNYLD | 2392 | LGSNRAS | 3086 | CMQALQTPITF | 3780 | hFzd4L |
| 040S-F02 | hFzd4L | RASQGIRND LG | 2393 | AASNLQS | 3087 | CQQSYSTPLTF | 3781 | hFzd4L |
| 040S-E04 | hFzd4L | RSSRSLLYS NGYNYLD | 2394 | LASHRAS | 3088 | CMQALQTPYTF | 3782 | hFzd4L |
| 040S-D05 | hFzd4L | TLHSGINVG TYRIY | 2395 | DKSDSDN HKGS | 3089 | CMIWHNNAWVF | 3783 | hFzd4L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 039S-G11 | hFzd4L | RASQSISSY LN | 2396 | KASNLEN | 3090 | CQQTYSMPLTF | 3784 | hFzd4L |
| 040S-G01 | hFzd4L | KSSQSLLYS SNNKNYLA | 2397 | GASTRYS | 3091 | CQQYYSTPVTF | 3785 | hFzd4L |
| 036S-C01 | hFzd5L | RASETISSW LA | 2398 | GASSLQS | 3092 | CQQYGSSPLTF | 3786 | hFzdSL |
| 036S-F01 | hFzdSL | RSSQSLLHS NGYNYLD | 2399 | LGSDRAS | 3093 | CMQGLQTPLTF | 3787 | hFzdSL, mFzd5L |
| 036S-B02 | hFzdSL | RSSQSLLHS NGYNYLD | 2400 | AASSLQS | 3094 | CMQGTHWPLTF | 3788 | hFzdSL |
| 036S-D02 | hFzdSL | RZSQSLLHS ZGYNYLD | 2401 | AASNWQS | 3095 | CMQSFQTPFTF | 3789 | hFzdSL |
| 036S-F02 | hFzdSL | RSSQSLLHS NGYNYLD | 2402 | LGSNRAS | 3096 | CMQGLQTPLTF | 3790 | hFzdSL |
| 036S-G02 | hFzdSL | RSSQSLLHS NGYNYLD | 2403 | LGSNRAS | 3097 | CMQGLQTPLTF | 3791 | hFzdSL |
| 036S-H02 | hFzdSL | RSSQSLLHS NGYNYLD | 2404 | LGSDRAS | 3098 | CMQALQTPLTF | 3792 | hFzdSL |
| 036S-A03 | hFzd5L | RSSQSLLHS NGYNYLD | 2405 | LAZDRAS | 3099 | CMQVLQTPLTF | 3793 | hFzdSL |
| 036S-C03 | hFzdSL | RSSQSLLHS NGYNYLD | 2406 | LGSNRAS | 3100 | CMQGLQTPLTF | 3794 | hFzdSL |
| 036S-C04 | hFzdSL | RASQSISSS LN | 2407 | DASYLQS | 3101 | CQQGYSIPFTF | 3795 | hFzdSL |
| 036S-D04 | hFzdSL | RASETISSW LA | 2408 | GASSLQS | 3102 | CQQYGRSPLTF | 3796 | hFzdSL |
| 036S-E04 | hFzd5L | RSSQSLLHS NGYNYLD | 2409 | DGSNLET | 3103 | CMQGTQRPLTF | 3797 | hFzdSL |
| 036S-A05 | hFzd5L | RASQNIGPW LA | 2410 | DASNLET | 3104 | CQQSYSIPLTF | 3798 | hFzdSL, mFzd5L |
| 036S-B05 | hFzdSL | RSSQSLLHS NGYNYLD | 2411 | DASNLET | 3105 | CMQGTHWPWTF | 3799 | hFzdSL |
| 036S-C05 | hFzdSL | RSSQSLLHS NGYNYLD | 2412 | AASNLQS | 3106 | CMQVLQPPYTF | 3800 | hFzdSL |
| 036S-D05 | hFzdSL | RCSQSLLPS NGYNYLD | 2413 | LGSNRAS | 3107 | CMQGLQTPITF | 3801 | hFzdSL |
| 036S-D01-3 | hFzdSL | RASQDISNW LA | 2414 | AASTLQS | 3108 | CQQANSFPLTF | 3802 | hFzdSL |
| 036S-D02-5 | hFzd5L | RASQGINNY LN | 2415 | AASSLQS | 3109 | CQQSYNTPFTF | 3803 | hFzdSL |
| 036S-G03-3 | hFzdSL | RASQGIAGW LA | 2416 | DASNLET | 3110 | CQQSYSTPLTF | 3804 | hFzdSL |
| 040S-D07 | hFzd6L | RASQSINRW LA | 2417 | AASTLQS | 3111 | CQQIHSYPLTF | 3805 | hFzd6L, mFzd6L |
| 040S-E08 | hFzd6L | RSSQSLLHS NGYNYLD | 2418 | AASSLQS | 3112 | CMQALQTPLTF | 3806 | hFzd6L, mFzd6L |
| 040S-B09 | hFzd6L | RASQTISNF LN | 2419 | AASSLQS | 3113 | CQQSYSPPYTF | 3807 | hFzd6L, mFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 040S-H09 | hFzd6L | RASQGISNY LN | 2420 | YASSlQS | 3114 | CQQTDSIPITF | 3808 | hFzd6L, mFzd6L |
| 040S-E10 | hFzd6L | RASQSISSY LN | 2421 | AASSLQS | 3115 | CQQSYNTPFTF | 3809 | hFzd6L, mFzd6L |
| 040S-Dll | hFzd6L | KSSQSVLYS SNNKNYLA | 2422 | STNTRSS | 3116 | CQQYYSIPVTF | 3810 | hFzd6L, mFzd6L |
| 041S-B01 | hFzd6L | RASQSIHSW LA | 2423 | AASNLQS | 3117 | CQQGYSTPPTF | 3811 | hFzd6L, mFzd6L |
| 040S-E07 | hFzd6L | RASQSISSY LN | 2424 | GASNLQR | 3118 | CQQSFSPPLTF | 3812 | hFzd6L, mFzd6L |
| 040S-B08 | hFzd6L | RASQSISSY LN | 2425 | AASSLQS | 3119 | CQQSYSTPLTF | 3813 | hFzd6L, mFzd6L |
| 040S-F08 | hFzd6L | KSSQSVLYS SNNKNYLA | 2426 | WASTRKS | 3120 | CHQYYSLPITF | 3814 | hFzd6L, mFzd6L |
| 040S-B12 | hFzd6L | RASQSVSNN YLA | 2427 | GASTRAT | 3121 | CHQYGSTPLTF | 3815 | hFzd6L, mFzd6L |
| 040S-H06 | hFzd6L | RASQSVSSN LA | 2428 | GASTRAT | 3122 | CQQYFSAPRTF | 3816 | hFzd6L, mFzd6L |
| 040S-F07 | hFzd6L | RASQGISNN LN | 2429 | GAYTLHS | 3123 | CQQSYTTLSTF | 3817 | hFzd6L, mFzd6L |
| 040S-G08 | hFzd6L | QASRDISNY LN | 2430 | GASSLQS | 3124 | CQQSYSAPLAF | 3818 | hFzd6L, mFzd6L |
| 040S-B10 | hFzd6L | RSSQSLLHS NGYNYLD | 2431 | AASTLQD | 3125 | CMQAIQSPPTF | 3819 | hFzd6L, mFzd6L |
| 040S-G10 | hFzd6L | KSSQSVLYS SNNKNYLA | 2432 | WASDRES | 3126 | CQQYYSTPITF | 3820 | hFzd6L, mFzd6L |
| 040S-C12 | hFzd6L | RASQSISSW LA | 2433 | DASRLER | 3127 | CQKYNSAPLTF | 3821 | hFzd6L, mFzd6L |
| 040S-A07 | hFzd6L | RSSQSLLHS NGYNYLD | 2434 | AASSLQS | 3128 | CMQALQNPITF | 3822 | hFzd6L, mFzd6L |
| 040S-G07 | hFzdBL | RASQAISSY LA | 2435 | AASILQS | 3129 | CQQSSRTPPTF | 3823 | hFzd6L, mFzd6L |
| 040S-C10 | hFzd6L | RASQSISSY LN | 2436 | DASNLET | 3130 | CQQSHSAPITF | 3824 | hFzd6L, mFzd6L |
| 040S-F12 | hFzd6L | RASQSVSSY LA | 2437 | GASTRAT | 3131 | CQQYGNLITF | 3825 | hFzd6L, mFzd6L |
| 040S-E11 | hFzd6L | RASQSISSY LD | 2438 | AASSLQS | 3132 | CQQSYSSPLTF | 3826 | hFzd6L, mFzd6L |
| 040S-G12 | hFzd6L | RASQGISNY LA | 2439 | AASSLHS | 3133 | CQQYGNLPYTF | 3827 | hFzd6L, mFzd6L |
| 041S-D01 | hFzd6L | RASQSISSY LN | 2440 | AASSLQS | 3134 | CQQSYSTPITF | 3828 | hFzd6L, mFzd6L |
| 040S-H07 | hFzd6L | RSSRSLVYN ANNKSYLA | 2441 | WASTRES | 3135 | CQQYYSVPLTF | 3829 | hFzd6L, mFzd6L |
| 040S-C08 | hFzd6L | RASESIGSY LN | 2442 | AASSLQS | 3136 | CQQANSFPPTF | 3830 | hFzd6L, mFzd6L |
| 040S-H08 | hFzd6L | RASQSISNW LA | 2443 | AASTLQS | 3137 | CQQSASPPPTF | 3831 | hFzd6L, mFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 040S-C09 | hFzd6L | QASQGISNY LA | 2444 | AASSLQS | 3138 | CQQSYSIPFTF | 3832 | hFzd6L, mFzd6L |
| 040S-H10 | hFzd6L | QASQSIYNY LN | 2445 | KASTLES | 3139 | CQQSYSIPFTF | 3833 | hFzd6L, mFzd6L |
| 040S-F11 | hFzd6L | QASQDISNY LN | 2446 | GASTLQS | 3140 | CEQSYSTPLTF | 3834 | hFzd6L, mFzd6L |
| 041S-A01 | hFzd6L | RSSQSVLSS STYKNYLA | 2447 | WASTRES | 3141 | CQQYYATPFTF | 3835 | hFzd6L, mFzd6L |
| 041S-E01 | hFzd6L | RASRSIGPW LA | 2448 | ATSSLHG | 3142 | CQQSHSVPLTF | 3836 | hFzd6L, mFzd6L |
| 040S-B07 | hFzd6L | RSSQSLLHS NGYNYLD | 2449 | AASSLRS | 3143 | CMQSRHWPLTF | 3837 | hFzd6L, mFzd6L |
| 040S-D08 | hFzd6L | RASQSVSTW LA | 2450 | AASSLQS | 3144 | CQQSYSSPPTF | 3838 | hFzd6L, mFzd6L |
| 040S-D05 | hFzd6L | RVSQDISNS LN | 2451 | AASSLQS | 3145 | CQQSYSTPLTF | 3839 | hFzd6L, mFzd6L |
| 040S-F09 | hFzd6L | KSSQSVLYS SNNKNYLA | 2452 | WASTRES | 3146 | CQQYYDTPLTF | 3840 | hFzd6L, mFzd6L |
| 040S-D10 | hFzd6L | RASQGISNY LA | 2453 | KASSLES | 3147 | CQQTYAIPLTF | 3841 | hFzd6L, mFzd6L |
| 040S-A11 | hFzd6L | RASQSISSS YLA | 2454 | GASTRAT | 3148 | CQQYDNLPITF | 3842 | hFzd6L, mFzd6L |
| 040S-D12 | hFzd6L | RSSQSLLHS NGYNYLD | 2455 | LGSNRAS | 3149 | CMQALQTPYTF | 3843 | hFzd6L, mFzd6L |
| 041S-F01 | hFzd6L | RASQSISSY LN | 2456 | AASILEN | 3150 | CQQAHSFPLTF | 3844 | hFzd6L, mFzd6L |
| 040S-B11 | hFzd6L | RSSQSLLHS NGYNYLD | 2457 | AASSLQS | 3151 | CMQGTRWPPTF | 3845 | hFzd6L, mFzd6L |
| 040S-G11 | hFzd6L | QASQDISNY LN | 2458 | AASTLQS | 3152 | CQQSHSTPPTF | 3846 | hFzd6L, mFzd6L |
| 040S-C07 | hFzd6L | RASQSISTY LN | 2459 | AASSLQS | 3153 | CQQSYSTPWTF | 3847 | hFzd6L, mFzd6L |
| 040S-A08 | hFzd6L | RASQSINRW LA | 2460 | KASSLES | 3154 | CQQSYSIPFTF | 3848 | hFzd6L, mFzd6L |
| 040S-A09 | hFzd6L | QASQDISNY LN | 2461 | TASSLRS | 3155 | CQQANSFPITF | 3849 | hFzd6L, mFzd6L |
| 040S-C11 | hFzd6L | RASQSISSY LN | 2462 | ASSTLQS | 3156 | CQQSYSTPLTF | 3850 | hFzd6L, mFzd6L |
| 040S-H11 | hFzd6L | KSSQSVLYS SNNKNYLA | 2463 | WASTRES | 3157 | CQQYYSIPLTF | 3851 | hFzd6L, mFzd6L |
| 041S-D02 | hFzd6L | RSSQSLLHS NGYNYLD | 2464 | LGSNRAS | 3158 | CMQALQPPLTF | 3852 | hFzd6L, mFzd6L |
| 041S-A04 | hFzd6L | RASQGISNY LA | 2465 | GASTLQS | 3159 | CQQSFNGPLTF | 3853 | hFzd6L, mFzd6L |
| 041S-A08 | hFzd6L | QASQDISNY LN | 2466 | ATSSLQS | 3160 | CQQSYSIPPTF | 3854 | hFzd6L, mFzd6L |
| 041S-F08 | hFzd6L | RSSQSLLHS NGYNYLD | 2467 | AASSLQS | 3161 | CMQALQIPFTF | 3855 | hFzd6L, mFzd6L |

TABLE 2-continued

Clone IDs and CDR sequences for hinge specific ("L") or hinge (L) + CRD ("ext") binders. "CDRH" indicates heavy chain CDRs, and "CDRL" indicates light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 04 IS-HOI | hFzd6L | RASQNVNRW LA | 2468 | AASTLQS | 3162 | CQQSYSTPPTF | 3856 | hFzd6L, mFzd6L |
| 041S-E02 | hFzd6L | RASQSISSY LN | 2469 | DASTLQS | 3163 | CQQTSSTPLTF | 3857 | hFzd6L, mFzd6L |
| 041S-C03 | hFzd6L | RSSQSLLHS NGYNYLD | 2470 | LGSSRAS | 3164 | CMQGTQWPPTF | 3858 | hFzd6L, mFzd6L |
| 041S-F06 | hFzd6L | RASQGISNY LA | 2471 | AASSLQS | 3165 | CQQSYSTPLTF | 3859 | hFzd6L, mFzd6L |
| 041S-F07 | hFzd6L | RASQGISNY LA | 2472 | GTSNLET | 3166 | CQQYDRYPYIF | 3860 | hFzd6L, mFzd6L |
| 041S-G08 | hFzd6L | RASQGISSY LA | 2473 | AASNLQS | 3167 | CQQSYSTPLTF | 3861 | hFzd6L, mFzd6L |
| 041S-F02 | hFzd6L | RASQGINNY LA | 2474 | RASSLQR | 3168 | CQQSYTTPPTF | 3862 | hFzd6L, mFzd6L |
| 041S-D03 | hFzd6L | RASQTTKNY LN | 2475 | AASSLQS | 3169 | CQQSYRIPFSF | 3863 | hFzd6L, mFzd6L |
| 041S-C05 | hFzd6L | RAGQSIGSF LN | 2476 | DAKDLHP | 3170 | CQQSHTAPLTF | 3864 | hFzd6L, mFzd6L |
| 041S-G06 | hFzd6L | RASQAIRND LA | 2477 | AASRLQS | 3171 | CQQSFATPRTF | 3865 | hFzd6L, mFzd6L |
| 041S-C08 | hFzd6L | RASQGISNY LA | 2478 | AASNLQS | 3172 | CQQYQSYPWTF | 3866 | hFzd6L, mFzd6L |
| 041S-H08 | hFzd6L | RASQSISSY LN | 2479 | DASNLET | 3173 | CQQSHSAPITF | 3867 | hFzd6L, mFzd6L |
| 041S-E09 | hFzd6L | RSSQSLLHS NGYNYLD | 2480 | AASSLQS | 3174 | CMQGTHWPPTF | 3868 | hFzd6L, mFzd6L |
| 041S-G02 | hFzd6L | RASQSVSSN YLA | 2481 | ATSARAT | 3175 | CQQYGTSPITF | 3869 | hFzd6L, mFzd6L |
| 041S-C04 | hFzd6L | RASQSVASS YLA | 2482 | GASTRAT | 3176 | CQQYGSSPITF | 3870 | hFzd6L, mFzd6L |
| 041S-D05 | hFzd6L | RASQSVSSY LA | 2483 | GASTRAT | 3177 | CQQYGSLPIAF | 3871 | hFzd6L, mFzd6L |
| 041S-A06 | hFzd6L | RASQSVSSS YLA | 2484 | GASTRAT | 3178 | CQQYGSSPITF | 3872 | hFzd6L, mFzd6L |
| 041S-H06 | hFzd6L | RASQSISSW LA | 2485 | AASNLQS | 3179 | CQQAKSFPPTF | 3873 | hFzd6L, mFzd6L |
| 041S-F09 | hFzd6L | RASQSISRY LN | 2486 | DATNLPT | 3180 | CQQANSFPLTF | 3874 | hFzd6L, mFzd6L |
| 041S-B02 | hFzd6L | RASQGISNY LA | 2487 | DASHLET | 3181 | CQQYDNLPLTF | 3875 | hFzd6L, mFzd6L |
| 041S-H02 | hFzd6L | RSSQSLLHS NGYNYLD | 2488 | LGSNRAS | 3182 | CMQGTHWPPTF | 3876 | hFzd6L, mFzd6L |
| 041S-F03 | hFzd6L | RSSQSLLHS NGYNYLD | 2489 | LGSNRAS | 3183 | CMQGTHWPLTF | 3877 | hFzd6L, mFzd6L |
| 041S-D04 | hFzd6L | RSSQSLLHS NGYNYLD | 2490 | AASSLQS | 3184 | CMQHTHWPPTF | 3878 | hFzd6L, mFzd6L |
| 041S-G04 | hFzd6L | RSSQSLLHS NGYNYLD | 2491 | KASSLEN | 3185 | CMQGSHWPPTF | 3879 | hFzd6L, mFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|----------|---------|-------|--------------|-------|--------------|-------|--------------|-------------------|
| 041S-E05 | hFzd6L | RASQGISNY LA | 2492 | GASNLQS | 3186 | CQQSYSPPLTF | 3880 | hFzd6L, mFzd6L |
| 041S-A07 | hFzd6L | QASQDISNY LN | 2493 | AASTLQS | 3187 | CQQANSFPPSF | 3881 | hFzd6L, mFzd6L |
| 041S-H07 | hFzd6L | RSSQSLLHS NGYNYLD | 2494 | KASSLES | 3188 | CMQGLQTPVTF | 3882 | hFzd6L, mFzd6L |
| 041S-D08 | hFzd6L | RASQSISSY LN | 2495 | AASRLQS | 3189 | CQQSFRIPPTF | 3883 | hFzd6L, mFzd6L |
| 041S-A09 | hFzd6L | RASQGIRND LG | 2496 | AASSLQS | 3190 | CQQSYSIPFTF | 3884 | hFzd6L, mFzd6L |
| 041S-G03 | hFzd6L | QASQDISDY LN | 2497 | AASTLQS | 3191 | CQQYYSTPITF | 3885 | hFzd6L, mFzd6L |
| 041S-E04 | hFzd6L | RSSQSLLHS NGYNYLD | 2498 | KASSLES | 3192 | CMQGTHWPLTF | 3886 | hFzd6L, mFzd6L |
| 041S-H04 | hFzd6L | RSSQSLLHS NGYNYLD | 2499 | LGSNRAS | 3193 | CMQVLQNPITF | 3887 | hFzd6L, mFzd6L |
| 041S-F05 | hFzd6L | QASQDISNY LA | 2500 | KASSLES | 3194 | CQQGYRTPPTF | 3888 | hFzd6L, mFzd6L |
| 041S-C06 | hFzd6L | RSSQSLLHS NGYNYLD | 2501 | LGSNRAS | 3195 | CMQALQTPPTF | 3889 | hFzd6L, mFzd6L |
| 041S-B07 | hFzd6L | RASQSVSSS YLA | 2502 | DISSRAS | 3196 | CQQYGSSPLTF | 3890 | hFzd6L, mFzd6L |
| 041S-B09 | hFzdBL | RASQSINTY LN | 2503 | AASTLHS | 3197 | CQQSFNTPLTF | 3891 | hFzd6L, mFzd6L |
| 041S-H09 | hFzd6L | RASQGIKNY LA | 2504 | AASTLKS | 3198 | CQQSYSPPRTF | 3892 | hFzd6L, mFzd6L |
| 041S-A03 | hFzd6L | KSSQSVLYR SNNKNYLA | 2505 | WASTRES | 3199 | CQQYYGLPYTF | 3893 | hFzd6L, mFzd6L |
| 041S-A05 | hFzd6L | RASQDISNY LN | 2506 | DASSLQS | 3200 | CQQSYSPPRTF | 3894 | hFzd6L, mFzd6L |
| 041S-G05 | hFzd6L | RSSRSLLHS NGYNYLD | 2507 | LGSDRAS | 3201 | CMQALQTPPTF | 3895 | hFzd6L, mFzd6L |
| 041S-D06 | hFzd6L | RASQSISSY LN | 2508 | AASTLQS | 3202 | CQQSYSIPYTF | 3896 | hFzd6L, mFzd6L |
| 041S-C07 | hFzd6L | QASQDISNY LN | 2509 | SASNLQS | 3203 | CQHSYSAPLTF | 3897 | hFzd6L, mFzd6L |
| 041S-E08 | hFzd6L | QASQDIRNH LN | 2510 | SVSNLQS | 3204 | CQQANTFPPAF | 3898 | hFzd6L, mFzd6L |
| 041S-C09 | hFzd6L | RASQSIANH LN | 2511 | AATTLRS | 3205 | CQQSYSAPYTF | 3899 | hFzd6L, mFzd6L |
| 041S-A10 | hFzd6L | RASQSIANH LN | 2512 | AATTLRS | 3206 | CQQSYSAPYTF | 3900 | hFzd6L, mFzd6L |
| 041S-C02 | hFzd6L | RASQGISSW LS | 2513 | AASNLQS | 3207 | CQQSFAPPRTF | 3901 | hFzd6L, mFzd6L |
| 041S-B03 | hFzd6L | RASQSIANH LN | 2514 | AATTLRS | 3208 | CQQSYSAPYTF | 3902 | hFzd6L, mFzd6L |
| 041S-F04 | hFzd6L | RASQSVGTY LA | 2515 | GASTRAT | 3209 | CQQYGSSALTF | 3903 | hFzd6L, mFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 041S-B05 | hFzd6L | RASQSISNW LA | 2516 | DASNLET | 3210 | CQQGSSFPLTF | 3904 | hFzd6L, mFzd6L |
| 041S-E06 | hFzd6L | RASQSISSY LN | 2517 | AASSLRS | 3211 | CQQSYSAPLTF | 3905 | hFzd6L, mFzd6L |
| 041S-D07 | hFzd6L | RASQSVSSY LA | 2518 | GASTRAT | 3212 | CQQYGSSPITF | 3906 | hFzd6L, mFzd6L |
| 041S-B10 | hFzd6L | RATQSVSSD YLA | 2519 | GASTRAT | 3213 | CQQYDNLPLTF | 3907 | hFzd6L, mFzd6L |
| 042S-F03 | hFzd6L | TRSSGSIAZ YYVQ | 2520 | EDDQRPS | 3214 | CQSYDRNSLVF | 3908 | hFzd6L, mFzd6L |
| 041S-C10 | hFzd6L | RSSQSLLHS NGYNYLD | 2521 | AASSLQS | 3215 | CMQSIQLPPTF | 3909 | hFzd6L, mFzd6L |
| 041S-H10 | hFzd6L | SGSKPNIGG HYVY | 2522 | RNTQRPS | 3216 | CATWDDSLSGV VF | 3910 | hFzd6L, mFzd6L |
| 042S-B02 | hFzd6L | TRSSGSIAS YYVQ | 2523 | EDDQRPS | 3217 | CQSYDRNSLVF | 3911 | hFzd6L, mFzd6L |
| 042S-G03 | hFzd6L | RSSKSLVYG DGNTYLN | 2524 | KVSNRDS | 3218 | CMQGTHWPPTF | 3912 | hFzd6L, mFzd6L |
| 041S-D10 | hFzdBL | TRSSGSIGD KYVQ | 2525 | QDDQRPS | 3219 | CQSYDSSNPHV VF | 3913 | hFzd6L, mFzd6L |
| 041S-G11 | hFzd6L | TGNSNNVGN RGAV | 2526 | RNNNRPS | 3220 | CSAWDSSLTVQ VF | 3914 | hFzd6L, mFzd6L |
| 042S-C01 | hFzd6L | TRSSGSIGD KYVQ | 2527 | QDDQRPS | 3221 | CQSYDSSNPHV VF | 3915 | hFzd6L, mFzd6L |
| 042S-A03 | hFzd6L | SGDKLGDKF AY | 2528 | QDNKRPS | 3222 | CQAWDTGTAVF | 3916 | hFzd6L, mFzd6L |
| 041SB11 | hFzd6L | RSSQSVZYS DVNCYLN | 2529 | KVSDLDY | 3223 | CMQGTHWPPTF | 3917 | hFzd6L, mFzd6L |
| 042S-A04 | hFzd6L | TGNSNNVGN RGAA | 2530 | RDNSRPS | 3224 | CSAWDSSLSVQ VF | 3918 | hFzd6L, mFzd6L |
| 041S-C11 | hFzd6L | TGNSNNVGN RGAV | 2531 | RNNNRPS | 3225 | CSAWDSSLTVQ VF | 3919 | hFzd6L, mFzd6L |
| 042S-D03 | hFzd6L | TRSSGSIGD KYVQ | 2532 | QDDQRPS | 3226 | CQSYDSSNPHV VF | 3920 | hFzd6L, mFzd6L |
| 042S-F04 | hFzd6L | TRNSGNIAT AYVQ | 2533 | QDFQRPS | 3227 | CQSYDNNYRAV F | 3921 | hFzd6L, mFzd6L |
| 042S-D01 | hFzd6L | SGSSSNIGS NAVN | 2534 | GSNERPS | 3228 | CAAWDDRFNGF ALF | 3922 | hFzd6L, mFzd6L |
| 042S-H01 | hFzd6L | TRSSGSIGD KYVQ | 2535 | QDDQRPS | 3229 | CQSYDSSNPHV VF | 3923 | hFzd6L, mFzd6L |
| 042S-C05 | hFzd6L | TRSSGSIGD KYVQ | 2536 | QDDQRPS | 3230 | CQSYDSSNPHV VF | 3924 | hFzd6L, mFzd6L |
| 041S-E11 | hFzdBL | TGNSNNVGN RGAV | 2537 | RNNNRPS | 3231 | CSAWDSSLTVQ VF | 3925 | hFzd6L, mFzd6L |
| 041S-B12 | hFzd6L | TRSSGSIGD KYVQ | 2538 | QDDQRPS | 3232 | CQSYDSSNPHV VF | 3926 | hFzd6L, mFzd6L |
| 041S-G12 | hFzd6L | TGNNYNVGN AGAA | 2539 | RNNDRPS | 3233 | CSAWDSSLKVQ VF | 3927 | hFzd6L, mFzd6L |

TABLE 2-continued

Clone IDs and CDR sequences for hinge specific ("L") or hinge (L) + CRD ("ext") binders. "CDRH" indicates heavy chain CDRs, and "CDRL" indicates light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 042S-E01 | hFzd6L | TRISISGNI ATAYVQ | 2540 | QDFQRPS | 3234 | CQSYDNNYRAV F | 3928 | hFzd6L, mFzd6L |
| 042S-B04 | hFzd6L | RSSQSLLHS NGYNYLD | 2541 | LGSNRAS | 3235 | CMQALQTPRSF | 3929 | hFzd6L, mFzd6L |
| 041S-G10 | hFzd6L | TGNSNNVGN AGAV | 2542 | RSNNRPS | 3236 | CSAWDTSLRVQ VF | 3930 | hFzd6L, mFzd6L |
| 042S-A02 | hFzd6L | TRSSGSIGD KYVQ | 2543 | QDDQRPS | 3237 | CQSYDSSNPHV VF | 3931 | hFzd6L, mFzd6L |
| 042S-C03 | hFzd6L | TGNSNNVGN RGAV | 2544 | RNNNRPS | 3238 | CSAWDSSLTVQ VF | 3932 | hFzd6L, mFzd6L |
| 042S-C04 | hFzd6L | RSSKSLVYZ DGNTYLN | 2545 | KVSNRDS | 3239 | CMQGTHWPPTF | 3933 | hFzd6L, mFzd6L |
| 042S-H07 | hFzd6L | TGTISDVGG YNYVS | 2546 | EVSHRPS | 3240 | CNSYTSSSTVI F | 3934 | hFzd6L, mFzd6L |
| 042S-G08 | hFzd6L | SGNSNNVGY AGAA | 2547 | RNNDRPS | 3241 | CSAWDSSLKVQ VF | 3935 | hFzd6L, mFzd6L |
| 042S-H09 | hFzd6L | SGNSNNVGY GGAV | 2548 | RNNNRPS | 3242 | CSAWDSSLSAQ VF | 3936 | hFzd6L, mFzd6L |
| 042S-D10 | hFzd6L | RSSQSUHSN GYNYLD | 2549 | LGSNRAS | 3243 | CMQALRTPYTF | 3937 | hFzd6L, mFzd6L |
| 042S-G10 | hFzd6L | SGNSNNVGY GGAV | 2550 | RNNNRPS | 3244 | CSAWDSSLSAQ VF | 3938 | hFzd6L, mFzd6L |
| 042S-A08 | hFzd6L | RSSQSLLHS NGYNYLD | 2551 | LGSNRAS | 3245 | CMQSIQLPLTF | 3939 | hFzd6L, mFzd6L |
| 042S-H08 | hFzd6L | TGNNYNVGN AGAA | 2552 | RNNDRPS | 3246 | CSSWDNSLSAQ VF | 3940 | hFzd6L, mFzd6L |
| 042S-E09 | hFzd6L | TGNNYNVGN AGAA | 2553 | RNNDRPS | 3247 | CSAWDSSLKVQ VF | 3941 | hFzd6L, mFzd6L |
| 042S-A06 | hFzd6L | TGNSNNVGN RGAV | 2554 | RNNNRPS | 3248 | CSAWDSSLTVQ VF | 3942 | hFzd6L, mFzd6L |
| 042S-F06 | hFzd6L | SGKNYZVGN AGAA | 2555 | RNNDRPS | 3249 | CSAWDSSLKVQ VF | 3943 | hFzd6L, mFzd6L |
| 042S-B08 | hFzd6L | RSSKSLVYS DGNTYLN | 2556 | KVSNRDS | 3250 | CMQGTHWPPTF | 3944 | hFzd6L, mFzd6L |
| 042S-A09 | hFzd6L | TGNNYNVGN AGAA | 2557 | RNNDRPS | 3251 | CSSWDNSLSAQ VF | 3945 | hFzd6L, mFzd6L |
| 042S-H10 | hFzd6L | SGNNNVGF AGAA | 2558 | RNNDRPS | 3252 | CSAWDSSLKVQ VF | 3946 | hFzd6L, mFzd6L |
| 042S-D07 | hFzd6L | KSSKSLVYG DGNTYLN | 2559 | KVSNRDS | 3253 | CMQGTHWPPTF | 3947 | hFzd6L, mFzd6L |
| 042S-B09 | hFzd6L | SGNSNNVGY GGAV | 2560 | RNNNRPS | 3254 | CSAWDSSLSAQ VF | 3948 | hFzd6L, mFzd6L |
| 042S-A11 | hFzd6L | SGSSSNIGN NHVS | 2561 | ANNKRPS | 3255 | CGTWDGSLSSG VF | 3949 | hFzd6L, mFzd6L |
| 042S-H06 | hFzd6L | TGNSNNVGN RGAV | 2562 | RNNNRPS | 3256 | CSAWDSSLTVQ VF | 3950 | hFzd6L, mFzd6L |
| 042S-E07 | hFzd6L | TGNSNNVGN RGAV | 2563 | RNNNRPS | 3257 | CSAWDSSLTVQ VF | 3951 | hFzd6L, mFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 042S-D08 | hFzd6L | TGSSNNVGN AGAA | 2564 | RNNDRPS | 3258 | CSSWDSSLKVQ LF | 3952 | hFzd6L, mFzd6L |
| 042S-F09 | hFzd6L | TRSGGGIAS SFVQ | 2565 | QDDQRPS | 3259 | CQSYGSGFVVF | 3953 | hFzd6L, mFzd6L |
| 042S-A10 | hFzd6L | SGSTSNKSY SFVS | 2566 | DNSKRPS | 3260 | CAAWDLPLNAV VF | 3954 | hFzd6L, mFzd6L |
| 042S-C09 | hFzd6L | TGNNYNVGN AGAA | 2567 | RNNDRPS | 3261 | CSAWDSSLKVQ VF | 3955 | hFzd6L, mFzd6L |
| 042S-F10 | hFzd6L | SGSSSNIGN NYVS | 2568 | ENNKRPS | 3262 | CGTWDSSLSAV VF | 3956 | hFzd6L, mFzd6L |
| 042S-D11 | hFzd6L | TGNNYNVGN AGAA | 2569 | RNNDRPS | 3263 | CSAWDSSLKVQ VF | 3957 | hFzd6L, mFzd6L |
| 042S-F07 | hFzd6L | TGTSSDVGG YNYVS | 2570 | GVSNRPS | 3264 | CSSYTRSSTLL F | 3958 | hFzd6L, mFzd6L |
| 042S-E08 | hFzdBL | RSSQSUHSN GYNYLD | 2571 | LGSNRAS | 3265 | CMQALQTSYTF | 3959 | hFzd6L, mFzd6L |
| 042S-B10 | hFzd6L | TGNSNNVGK GGAA | 2572 | RTLDRPS | 3266 | CSAWDSSLRVQ VF | 3960 | hFzd6L, mFzd6L |
| 042S-B11 | hFzd6L | TGNNYNVGN AGAA | 2573 | RNNDRPS | 3267 | CSSWDNSLSAQ VF | 3961 | hFzd6L, mFzd6L |
| 042S-F11 | hFzd6L | TRSSGSIAS NYVQ | 2574 | DDNQRPS | 3268 | CQSYDSSSVVF | 3962 | hFzd6L, mFzd6L |
| 042S-B07 | hFzd6L | TGNSNNVGN RGAV | 2575 | RNNNRPS | 3269 | CSAWDSSLTVH VF | 3963 | hFzd6L, mFzd6L |
| 042S-G07 | hFzd6L | KSSQSLLYF NGNTYLS | 2576 | QVSNRDS | 3270 | CMQGTQWPPTF | 3964 | hFzd6L, mFzd6L |
| 042S-F08 | hFzd6L | TRSSGSIAS NYVR | 2577 | DDDQRPS | 3271 | CQSFDTSNQVF | 3965 | hFzd6L, mFzd6L |
| 042S-C10 | hFzd6L | TGNNYNVGN AGAA | 2578 | RNNDRPS | 3272 | CSSWDNSLSAQ VF | 3966 | hFzd6L, mFzd6L |
| 043S-D05 | hFzd6L | RSSQSLVYS DGDTYLN | 2579 | KVSKRDS | 3273 | CMQGTHWPPTF | 3967 | hFzd6L, mFzd6L |
| 043S-H04 | hFzd6L | TGSSSNIGA GYDVH | 2580 | GNSNRPS | 3274 | CQSYDSSLSGW VF | 3968 | hFzd6L, mFzd6L |
| 043S-G08 | hFzd6L | TGSSSNIGA GYDVH | 2581 | GNSNRPS | 3275 | CQSYDSSLSGW VF | 3969 | hFzd6L, mFzd6L |
| 043S-D09 | hFzd6L | RSSQSLVHS DGNTYLN | 2582 | QVSNRDS | 3276 | CMQGTHWPPTF | 3970 | hFzd6L, mFzd6L |
| 043S-E09 | hFzd6L | TRSSGSIGD KYVQ | 2583 | QDDQRPS | 3277 | CQSYDSSNPHV VF | 3971 | hFzd6L, mFzd6L |
| 043S-F07 | hFzd6L | TGNSNNVGN RGAV | 2584 | RNNNRPS | 3278 | CSAWDSSLTVQ VF | 3972 | hFzd6L, mFzd6L |
| 043S-H07 | hFzd6L | TGNSNNVGN RGAV | 2585 | RNNNRPS | 3279 | CSAWDSSLTVQ VF | 3973 | hFzd6L, mFzd6L |
| 043S-F08 | hFzd6L | TGNNYNVGN AGAA | 2586 | RNNDRPS | 3280 | CSAWDSSLKVQ VF | 3974 | hFzd6L, mFzd6L |
| 043S-C09 | hFzd6L | TGNSNNVGK GGAA | 2587 | RTLDRPS | 3281 | CSAWDSSLRVQ VF | 3975 | hFzd6L, mFzd6L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 031S-G02 | hFzd7ext | RSSQSLVYS DGNTYLN | 2588 | KVSNRDS | 3282 | CMQGTHWPPTF | 3976 | hFzd7L |
| 031S-A03 | hFzd7ext | RSSQSLLHS NGYNYLD | 2589 | SASNLQS | 3283 | CMQSLQTPVTF | 3977 | hFzd7L |
| 031S-B03 | hFzd7ext | RSSQSLLHS NGYNYLD | 2590 | LGSKRPS | 3284 | CMQALQTPITF | 3978 | hFzd7L |
| 031S-C03 | hFzd7ext | RASQGIRND LA | 2591 | AASSLQS | 3285 | CQQIHSYPLTF | 3979 | hFzd7L |
| 031S-D03 | HFzd7ext | RSSQSLLHS NGYNYLD | 2592 | EVSNRAS | 3286 | CMQGSHWPPTF | 3980 | hFzd7L |
| 031S-E03 | hFzd7ext | RSSQSLLHS NGYNYLD | 2593 | AASSLQS | 3287 | CMQALQTPITF | 3981 | hFzd7L |
| 031S-F03 | hFzd7ext | RSSQSLLHS NGYNYLD | 2594 | AASSLQS | 3288 | CMQSIQLPrTF | 3982 | hFzd7L |
| 031S-G03 | hFzd7ext | RSSQSLLHS NGYNYLD | 2595 | AASSLQS | 3289 | CMQALQTPITF | 3983 | hFzd7L |
| 031S-H03 | hFzd7ext | RASQSISSY LN | 2596 | AASTLQS | 3290 | CQQANSFPLTF | 3984 | hFzd2L, 7L |
| 031S-A04 | hFzd7ext | RSSQSLLHS NGYNYLD | 2597 | DASNLET | 3291 | CMQALQTPITF | 3985 | hFzd7L |
| 031S-C04 | hFzd7ext | RSSQSLLHS NGYNYLD | 2598 | AASSLQS | 3292 | CMQSLQTPITF | 3986 | hFzd7L |
| 031S-DQ4 | hFzd7ext | RSSQSLLHS NGYNYLD | 2599 | DASSLES | 3293 | CMQALQTPLTF | 3987 | hFzd7L |
| 031S-E04 | hFzd7ext | RASQNIGTW LA | 2600 | AASSLQS | 3294 | CQQSYSSPLTF | 3988 | hFzd7L |
| 031S-F04 | hFzd7ext | RSSQSLLHS NGYNYLD | 2601 | LGSNRAS | 3295 | CMQAVQVPITF | 3989 | hFzd2L, 7L |
| 031S-G04 | hFzd7ext | RSSQSLLHS NGYNYLD | 2602 | AASSLQS | 3296 | CMQALQTPLTF | 3990 | hFzd7L |
| 031S-H04 | hFzd7ext | QASQEISNY LN | 2603 | AASKLHS | 3297 | CQQSYSSPLTF | 3991 | hFzd7L |
| 031S-A05 | hFzd7ext | RSSQSLLHS NGYNYLD | 2604 | AASTLHT | 3298 | CMQTLQTPFTF | 3992 | hFzd7L |
| 031S-B05 | hFzd7ext | KSSQSVLYG SNNKNYLA | 2605 | WASTRKS | 3299 | CQQYYSFPLTF | 3993 | hFzd7L |
| 031S-C05 | hFzd7ext | RSSQSLLHS NGYNYLD | 2606 | DASNLET | 3300 | CMQALQTPLTF | 3994 | hFzd7L |
| 031S-D05 | hFzd7ext | KSSQSVLYS SNNKNYLA | 2607 | WASTRES | 3301 | CQQYFTPPITF | 3995 | hFzd7L |
| 031S-E05 | hFzd7ext | RSSQSLLHS NGYNYID | 2608 | LGSNRAS | 3302 | CMQSTQIPWTF | 3996 | hFzd7L |
| 031S-F05 | hFzd7ext | RASQSINTH LN | 2609 | AASSLQS | 3303 | CQQSYSTPLTF | 3997 | hFzd2L, 7L |
| 031S-G05 | hFzd7ext | RASQSISTW LA | 2610 | AASSLQS | 3304 | CQQSYSPPITF | 3998 | hFzd7L |
| 031S-AQ6 | hFzd7ext | RSSQSLLHS NGYNYLD | 2611 | AASTLQP | 3305 | CMQALQTPITF | 3999 | hFzd7L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 031S-B06 | hFzd7ext | RSSQSLLHS NGYNYLD | 2612 | LGSLRAS | 3306 | CMQALQTPTF | 4000 | hFzd7L |
| 031S-D06 | hFzd7ext | RASQSVSSW LA | 2613 | AASSLQS | 3307 | CQQSYSAPLTF | 4001 | hFzd7L |
| 031S-E06 | hFzd7ext | RSSQSLLHS NGYNYLD | 2614 | LGSTRAS | 3308 | CMQALQTPTF | 4002 | hFzd7L |
| 031S-F06 | hFzd7ext | RASQGISSY LA | 2615 | AASNLHN | 3309 | CQQSYSTPLTF | 4003 | hFzd7L |
| 031S-G06 | hFzd7ext | RSSQSLLHS NGYNYLD | 2616 | AASSLQS | 3310 | CMQALQTPrTF | 4004 | hFzd1L, 2L, 7L |
| 031S-A07 | hFzd7ext | RSSQSLLHS NGYNYLD | 2617 | AASSLQS | 3311 | CMQALQIPLTF | 4005 | hFzd7L |
| 031SC07 | hFzd7ext | QASQDISNY LN | 2618 | AASTLQS | 3312 | CQQSYTIPITF | 4006 | hFzd1L, 2L, 7L |
| 031S-E07 | hFzd7ext | RASQGVSSY LA | 2619 | GASARAT | 3313 | CQQYGSSPITF | 4007 | hFzd1L, 2L, 7L |
| 031S-H07 | hFzd7ext | RSSQSLLHS NGYNYLD | 2620 | AASSLES | 3314 | CMQALQTPLTF | 4008 | hFzd7L |
| 031S-A08 | hFzd7ext | RASQSISSW LA | 2621 | AASSLQS | 3315 | CQQSHSAPITF | 4009 | hFzd2L, 7L |
| 031S-B08 | HFzd7ext | QASQDIGNY LN | 2622 | GASTLQS | 3316 | CQQSYSTPLTF | 4010 | hFzd7L |
| 031S-C08 | hFzd7ext | RASQGISNY LN | 2623 | GASSLQR | 3317 | CQQSYSMPLTF | 4011 | HFzd2L, 7L |
| 031S-D08 | hFzd7ext | RVSQGISNY LA | 2624 | DASNLET | 3318 | CQQSYSPPFTF | 4012 | hFzd7L |
| 031S-E08 | hFzd7ext | RSSQSLLHS NGYNYLD | 2625 | LGSNRAS | 3319 | CMQGRQTPTF | 4013 | hFzd7L |
| 031S-F08 | hFzd7ext | RASQSISRW LA | 2626 | AASSLQS | 3320 | CQQAYTFPLTF | 4014 | hFzd7L |
| 031S-G08 | hFzd7ext | RSSQSLLHS NGYNYLD | 2627 | AASSLQS | 3321 | CMQAIQIPITF | 4015 | hFzd7L |
| 031S-H08 | hFzd7ext | XASQDISNY LN | 2628 | DASSLES | 3322 | CQQANSFPLTF | 4016 | hFzd1L, 2L, 7L |
| 032S-G01 | mFzd7L | RSSQSLLHS NGYNYLD | 2629 | LASNRAS | 3323 | CMQALQTPTF | 4017 | hFzd7L, mFzd7L |
| 032S-H01 | mFzd7L | RASQSINNW LA | 2630 | SASSLQS | 3324 | CQQSYDTPITF | 4018 | hFzd7L, mFzd7L |
| 032S-A02 | mFzd7L | RSSQSLLHS NGYNYLD | 2631 | GWMNPYS GNTGYA | 3325 | CMQALQTPYTF | 4019 | hFzd7L, mFzd7L |
| 032S-B02 | mFzd7L | RSSQSLLHS NGYNYLD | 2632 | LGSNRAS | 3326 | CMQALQTPTF | 4020 | hFzd7L, mFzd7L |
| 032S-F02 | hFzd7L | RSSQSLLHS NGYNYLD | 2633 | AASNLET | 3327 | CMQARQAPYTF | 4021 | hFzd7L |
| 032S-D02 | hFzd7L | RSSQSLLHS NGYNYLD | 2634 | LGSNRAS | 3328 | CMQALQTPTF | 4022 | hFzd7L, mFzd7L |
| 032S-H02 | hFzd7L | RASQNISSY LN | 2635 | DASTLQS | 3329 | CQQSYSPPFTF | 4023 | hFzd7L, mFzd7L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 032S-A03 | hFzd7L | RASQGISSH LA | 2636 | KASSIES | 3330 | CLQHYSYPLTF | 4024 | hFzd7L |
| 049S-B02 | hFzd7L | RSSQSLLHS NGYNYLD | 2637 | LGSNRAS | 3331 | CMQALQAPTF | 4025 | hFzd7L, mFzd7L |
| 049S-D02 | hFzd7L | RASQAISNY LV | 2638 | DASTLQS | 3332 | CQQSYSTPFTF | 4026 | hFzd7L, mFzd7L |
| 049S-F02 | hFzd7L | KSSQSVLYS SNNKNYLA | 2639 | WASTRES | 3333 | CQQYYTTPITF | 4027 | hFzd7L, mFzd7L |
| 049S-H02 | hFzd7L | RSSQSLLHS NGYNYLD | 2640 | LGSNRAS | 3334 | CMQALQTPTF | 4028 | hFzd7L, mFzd7L |
| 049S-A03 | hFzd7L | RSSQSLLHS NGYNYLD | 2641 | LGSNRAS | 3335 | CMQAIQTPITF | 4029 | hFzd7L, mFzd7L |
| 049S-B03 | hFzd7L | KSSQSVLYS SNNKNYLA | 2642 | WASARES | 3336 | CQQYYSVPVTF | 4030 | hFzd7L, mFzd7L |
| 049S-C03 | hFzd7L | RASQSISSY LN | 2643 | AASSLQS | 3337 | CQQSYSTPLTF | 4031 | hFzd7 |
| 049S-E03 | hFzd7L | RSSQSLLHS NGYNYLD | 2644 | LGSNRAS | 3338 | CMQALQTPITF | 4032 | hFzd7L, mFzd7L |
| 049S-F03 | hFzd7t | RSSQSLLHS NGYNYLD | 2645 | LGSNRAS | 3339 | CMQALQTPHTF | 4033 | hFzd7L, mFzd7L |
| 049S-H03 | hFzd7L | RSSQSLLHS NGYNYLD | 2646 | LGSDRAS | 3340 | CMQAIQTPITF | 4034 | hFzd7L, mFzd7L |
| 049S-A04 | hFzd7L | RSSQSLLHS NGYNYLD | 2647 | LGSNRAS | 3341 | CMQALQTPLTF | 4035 | hFzd7L, mFzd7L |
| 049S-B04 | hFzd7L | RSSQSLLHS NGYNYLD | 2648 | DASNLVT | 3342 | CMQALQIPPTF | 4036 | hFzd7L, mFzd7L |
| 049S-C04 | hFzd7L | RSSQSLLHS NGYNYLD | 2649 | LASNRAS | 3343 | CMQALQTPTF | 4037 | hFzd7L, mFzd7L |
| 15G4-4 | mFzd8L | KSSQSLLDS DGKTYLN | 2650 | LVSKLDS | 3344 | CWQGTHFPYTF | 4038 | mFzd8L |
| 027S-E5 | hFzd8 | RASQGITKS LA | 2651 | AASNLAT | 3345 | CQQYNTFPITF | 4039 | hFzd8 |
| 037S-A01 | hFzd9L | RSSRSLLHS DGNTYLH | 2652 | LGSNRAS | 3346 | CAQVLQLPYTF | 4040 | hFzd9L |
| 050S-A01 | hFzd9L | QASQDISNY LN | 2653 | GASRLET | 3347 | CQQSYSTPLTF | 4041 | hFzd9, mFzd9 |
| 050S-B01 | hFzd9L | RSSQSLRVS NGAZYLD | 2654 | LGSNZQS | 3348 | CMQSFQPPFTF | 4042 | hFzd9, mFzd9 |
| 050S-C01 | hFzd9L | RASQZISRW LA | 2655 | DASTLQS | 3349 | CQQSYSTPLTF | 4043 | hFzd9, mFzd9 |
| 050S-D01 | hFzd9L | QASQDISZY LT | 2656 | RVSSLQT | 3350 | CQQSYNTPFTF | 4044 | hFzd9, mFzd9 |
| 050S-E01 | hFzd9L | RSSQSLLHS NGYNYLD | 2657 | DATNLPT | 3351 | CMQALQIPYTF | 4045 | hFzd9, mFzd9 |
| 050S-F01 | hFzd9L | RASQGISNN LN | 2658 | AASSLQS | 3352 | CQQANSFPHTF | 4046 | hFzd9, mFzd9 |
| 050S-G01 | hFzd9L | RASQGISNY LA | 2659 | GASSRQS | 3353 | CQQDYSNPLTF | 4047 | hFzd9, mFzd9 |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 050S-H01 | hFzd9L | RSSQSLLHS NGYNYLD | 2660 | DASSLQS | 3354 | CMQALQAPLTF | 4048 | hFzd9, mFzd9 |
| 050S-A02 | hFzd9L | RASQSISRW LA | 2661 | DASTLQS | 3355 | CQQSYSTPLTF | 4049 | hFzd9, mFzd9 |
| 050S-B02 | hFzd9L | RASQSISSW LA | 2662 | GASTLQS | 3356 | CQQCYDTPLTF | 4050 | hFzd9, mFzd9 |
| 050S-C02 | hFzd9L | RSSQSVLYS SNNKNYLA | 2663 | WASTRES | 3357 | CQQYYSTPPTF | 4051 | hFzd9, mFzd9 |
| 050S-D02 | hFzd9L | KSSQSVLYS SNNKNYLA | 2664 | WASTRES | 3358 | CQQYFSIPLTF | 4052 | hFzd9, mFzd9 |
| 050S E02 | hFzd9L | RASQNINNW LA | 2665 | GASSLET | 3359 | CQQAYSFPFTF | 4053 | hFzd9, mFzd9 |
| 050S-F02 | hFzd9L | QZSQDISNY LN | 2666 | ZASRWQS | 3360 | CQQAYSFPLTF | 4054 | hFzd9, mFzd9 |
| 050S-G02 | hFzd9L | RASQSINRW LA | 2667 | GASTLES | 3361 | CQQSYSTPLTF | 4055 | hFzd9, mFzd9 |
| 050S-H02 | hFzd9L | RSSQSLLHS NGYNYLD | 2668 | LGSNRAS | 3362 | CMQSLQPPFTF | 4056 | hFzd9, mFzd9 |
| 050S-A03 | hFzd9L | RASQSINRW LA | 2669 | DASTLQS | 3363 | CQQSYSTPLTF | 4057 | hFzd9, mFzd9 |
| 050S-B03 | hFzd9L | KSZQZVLYZ SNNKNYLZ | 2670 | ZASTRES | 3364 | CQQYYSTPLTF | 4058 | hFzd9, mFzd9 |
| 050S-C03 | hFzd9L | RASQSISSY LN | 2671 | AASILQT | 3365 | CQQDYNSPLTF | 4059 | hF2d9, mFzd9 |
| 050S-D03 | hFzd9L | RASQSISRW LA | 2672 | DASTLQS | 3366 | CQQSYSTPLTF | 4060 | hFzd9, mFzd9 |
| 050S-E03 | hFzd9L | RASQSINZZ LA | 2673 | GASTLQS | 3367 | CQQDYSTPFTF | 4061 | hFzd9, mFzd9 |
| 050S-F03 | hFzd9L | RASQSISSW LA | 2674 | AASSLQS | 3368 | CQQSYSTPFTF | 4062 | hFzd9, mFzd9 |
| 050S-G03 | hFzd9L | RASQSISRW LA | 2675 | DASTLQS | 3369 | CQQSYSTPLTF | 4063 | hFzd9, mFzd9 |
| 050S-M03 | hFzd9L | RASQSINRW LA | 2676 | SASTLES | 3370 | CQQDYSTPLTF | 4064 | hFzd9, mFzd9 |
| 050S-A04 | hFzd9L | RASZGISNZ LN | 2677 | AASSLQS | 3371 | CQQANSFPHTF | 4065 | hFzd9, mFzd9 |
| 050S-B04 | hFzd9L | KSSQSVLYS SNNKNYLA | 2678 | WASARHS | 3372 | CHQYYSVPFTF | 4066 | hFzd9, mFzd9 |
| 050S-C04 | hFzd9L | RASQSISTW LA | 2679 | GASTLHS | 3373 | CQQSYDTPFTF | 4067 | hFzd9, mFzd9 |
| 050S-D04 | hFzd9L | RASQSISRW LA | 2680 | DASTLQS | 3374 | CQQSYSTPLTF | 4068 | hFzd9, mFzd9 |
| 050S-E04 | hFzd9L | RASQGISNN LN | 2681 | AASSLQS | 3375 | CQQANSFPPTF | 4069 | hFzd9, mFzd9 |
| 050S-F04 | hFzd9L | QASQDISNY LN | 2682 | DGSFLET | 3376 | CQQANSFPLTF | 4070 | hFzd9, mFzd9 |
| 050S-G04 | hFzd9L | KSSQSVLYS SNNKNYLA | 2683 | WASTRES | 3377 | CQQYYRTPITF | 4071 | hFzd9, mFzd9 |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 050S-H04 | hFzd9L | RASQSINZY LA | 2684 | SASZLES | 3378 | CQQAYSFPLTF | 4072 | hFzd9, mFzd9 |
| 050S-A05 | hFzd9L | RASQSIASY LN | 2685 | DASNLET | 3379 | CQQSYSTPFTF | 4073 | hFzd9, mFzd9 |
| 050S-B05 | hFzd9L | RASZZISSY LZ | 2686 | AASTLQS | 3380 | CQQDYSYPLTF | 4074 | hFzd9, mFzd9 |
| 050S-C05 | hFzd9L | RASQGISSY LA | 2687 | GASSLQS | 3381 | CQQSYSTPFTF | 4075 | hFzd9, mFzd9 |
| 050S-D05 | hFzd9L | RSSQSLLHS NGYNYLD | 2688 | DASNLET | 3382 | CMQATQFPYTF | 4076 | hFzd9, mFzd9 |
| 050S-E05 | hFzd9L | RASQSVGHF LA | 2689 | AASRLQT | 3383 | CLQDYDYPLTF | 4077 | hFzd9, mFzd9 |
| 050S-F05 | hFzd9L | ZASQDIZNY LN | 2690 | GASSLQS | 3384 | CQQANSFPFTF | 4078 | hFzd9, mFzd9 |
| 050S-G05 | hFzd9L | RVSQGISSY LN | 2691 | AASSLQS | 3385 | CQQGYSTPFTF | 4079 | hFzd9, mFzd9 |
| 050S-H05 | hFzd9L | QASQDISNY LN | 2692 | DASNLET | 3386 | CQQAYDFPLTF | 4080 | hFzd9, mFzd9 |
| 050S-A06 | hFzd9L | RASQGISNY LA | 2693 | GASNLQS | 3387 | CQQSYDTPLTF | 4081 | hFzd9, mFzd9 |
| 050S-B06 | hFzd9L | QASQDISNY LN | 2694 | GASSLQS | 3388 | CQQANSFPFTF | 4082 | hFzd9, mFzd9 |
| 050S-C06 | hFzd9L | QASQDISNY LN | 2695 | RVSSLQT | 3389 | CQQSYNTPFTF | 4083 | hFzd9, mFzd9 |
| 050S-D06 | hFzd9L | KSSQTVLYN SNNKNYLA | 2696 | WASTRES | 3390 | CQQYYSTPLTF | 4084 | hFzd9, mFzd9 |
| 050S-E06 | hFzd9L | RASQSISTW LA | 2697 | KASSLES | 3391 | CQQSYSTPFTF | 4085 | hFzd9, mFzd9 |
| 050S-F06 | hFzd9L | KSSQSVLYN SNNKNYLA | 2698 | WASTRDS | 3392 | CQQYYSPPLTF | 4086 | hFzd9, mFzd9 |
| 050S-G06 | hFzd9L | RASQGISNN LN | 2699 | AASSLQS | 3393 | CQQANSFPPTF | 4087 | hFzd9, mFzd9 |
| 050S-A07 | hFzd9L | RASQGISNY LA | 2700 | AASSLQS | 3394 | CQQGNNFPWTF | 4088 | hFzd9, mFzd9 |
| 050S-B07 | hFzd9L | RASENINSW LA | 2701 | AASRLQS | 3395 | CQQSYSSWWTF | 4089 | hFzd9, mFzd9 |
| 050S-D07 | hFzd9L | RASQGISSW LA | 2702 | DASNLET | 3396 | CQQSYDSPLTF | 4090 | hFzd9, mFzd9 |
| 050S-E07 | hFzd9L | LSSSNNNNY LA | 2703 | WASTRQS | 3397 | CQQDYSFPITF | 4091 | hFzd9, mFzd9 |
| 050S-F07 | hFzd9L | RASQZISNN LN | 2704 | AASSLQS | 3398 | CQQANSFPPTF | 4092 | hFzd9, mFzd9 |
| 050S-G07 | hFzd9L | RSSQSLLHS NGYNYLD | 2705 | LGSNRAS | 3399 | CMQALQTPITF | 4093 | hFzd9, mFzd9 |
| 050S-A08 | hFzd9L | KSSQSVLYS SNNKNYLA | 2706 | WASTRES | 3400 | CQQYYRTPITF | 4094 | hFzd9, mFzd9 |
| 050S-B08 | hFzd9L | RASQFISSW LA | 2707 | GASSLQS | 3401 | CQQSYNTPFTF | 4095 | hFzd9, mFzd9 |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 050S-C08 | hFzd9L | QASQDISNY LN | 2708 | AASSLQS | 3402 | CQQSYNTPFTF | 4096 | hFzd9, mFzd9 |
| 050S-D08 | hFzd9L | RASQSISRW LA | 2709 | DASTLQS | 3403 | CQQSYSTPLTF | 4097 | hFzd9, mFzd9 |
| 050S-E08 | hFzd9L | RASQSISRW LA | 2710 | DASNLET | 3404 | CQQSYNTPITF | 4098 | hFzd9, mFzd9 |
| 050S-F08 | hFzd9L | KSSQSVLYS SNNKNYLA | 2711 | WASTRES | 3405 | CQQYYSTPLTF | 4099 | hFzd9, mFzd9 |
| 050S-G08 | hFzd9L | RASESIGSW LA | 2712 | SASTLQS | 3406 | CQQSYNTPWTF | 4100 | hFzd9, mFzd9 |
| 050S-H08 | hFzd9L | RASQGISNN LN | 2713 | AASSLQS | 3407 | CQQANSFPPTF | 4101 | hFzd9, mFzd9 |
| 050S-A09 | hFzd9L | RASQSISZW LA | 2714 | DASTLQS | 3408 | CQQSYSTPLTF | 4102 | hFzd9, mFzd9 |
| 050S-B09 | hFzd9L | RASQGISNN LN | 2715 | AASSLQS | 3409 | CQQANSFPPTF | 4103 | hFzd9, mFzd9 |
| 050S-C09 | hFzd9L | RASQEISSW LA | 2716 | GASSLQS | 3410 | CQQANSFPWTF | 4104 | hFzd9, mFzd9 |
| 050S-D09 | hFzd9L | RASZZISNN LN | 2717 | AASSLQS | 3411 | CQQANSFPPLF | 4105 | hFzd9, mFzd9 |
| 050S-E09 | hFzd9L | RASQSISSW LA | 2718 | EVSNRFS | 3412 | CQQSYSIPITF | 4106 | hFzd9, mFzd9 |
| 050S-F09 | hFzd9L | QASQDISNY LN | 2719 | AASRLQS | 3413 | CQQAYSFPLTF | 4107 | hFzd9, mFzd9 |
| 050S-G09 | hFzd9L | RASZGISNN LN | 2720 | AASSLQS | 3414 | CQQANSFPPTF | 4108 | hFzd9, mFzd9 |
| 050S-H09 | hFzd9L | RASQDITNY LN | 2721 | SASSLHS | 3415 | CQQTDSIPITF | 4109 | hFzd9, mFzd9 |
| 050S-A10 | hFzd9L | KSSQSVLYS SNNKNYLA | 2722 | WASTRES | 3416 | CQQYYSTPPTF | 4110 | hFzd9, mFzd9 |
| 050S-B10 | hFzd9L | RASQSINRW LA | 2723 | DASTLQS | 3417 | CQQSYSTPLTF | 4111 | hFzd9, mFzd9 |
| 050S-C10 | hFzd9L | RASQGISNN LN | 2724 | AASSLQS | 3418 | CQQANSFPPTF | 4112 | hFzd9, mFzd9 |
| 050S D10 | hFzd9L | RASQGISNY LA | 2725 | AASSLQS | 3419 | CQQANNFPWTF | 4113 | hFzd9, mFzd9 |
| 050S-E10 | hFzd9L | RASQSINRW LA | 2726 | DASTLQS | 3420 | CQQSYSTPLTF | 4114 | hFzd9, mFzd9 |
| 050S-F10 | hFzd9L | RASQSISSY LN | 2727 | QASSLES | 3421 | CLQDYNYPFTF | 4115 | hFzd9, mFzd9 |
| 050S-G10 | hFzd9L | RSSQSLZHS NGYNYLD | 2728 | LASNRAS | 3422 | CMQGLQPPFTF | 4116 | hFzd9, mFzd9 |
| 050S-H10 | hFzd9L | KSSQSVLYS SNNKNYLA | 2729 | WASTRAS | 3423 | CQQYYSTPLTF | 4117 | hFzd9, mFzd9 |
| 050S-A11 | hFzd9L | RASQSIGYW LA | 2730 | SASNLQS | 3424 | CQQAYSFPWTF | 4118 | hFzd9, mFzd9 |
| 050S-B11 | hFzd9L | RASQGISNN LN | 2731 | KASSLES | 3425 | CQQANSFPPTF | 4119 | hFzd9, mFzd9 |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 050S-C11 | hFzd9L | RASQSITRW LA | 2732 | DASTLQS | 3426 | CQQSYSTPLTF | 4120 | hFzd9, mFzd9 |
| 050S-D11 | hFzd9L | RASQSISRW LA | 2733 | DASTLQS | 3427 | CQQSYSTPLTF | 4121 | hFzd9, mFzd9 |
| 050S E11 | hFzd9L | RASZZISNZ LN | 2734 | AASSLZS | 3428 | CQQANSFPPTF | 4122 | hFzd9, mFzd9 |
| 050S-F11 | hFzd9L | RASQGIDNW LA | 2735 | AASSLQS | 3429 | CQQSYNLPLTF | 4123 | hFzd9, mFzd9 |
| 050S-G11 | hFzd9L | RASQSISSY LN | 2736 | AASILHS | 3430 | CLQDYSYPLTF | 4124 | hFzd9, mFzd9 |
| 050S-H11 | hFzd9L | RASQSISTY LN | 2737 | AASSLQS | 3431 | CQQSYSFPFTF | 4125 | hFzd9, mFzd9 |
| 050S-A12 | hFzd9L | RASQSISRW LA | 2738 | DASTLQS | 3432 | CQQSYSTPLTF | 4126 | hFzd9, mFzd9 |
| 050S-B12 | hFzd9L | RASQNIATY LN | 2739 | QASSLES | 3433 | CQQSYDTPFTF | 4127 | hFzd9, mFzd9 |
| 050S-C12 | hFzd9L | RASQEISSW LA | 2740 | GASSLQS | 3434 | CQQANSFPWTF | 4128 | hFzd9, mFzd9 |
| 050S-D12 | hFzd9L | RSSQSLLHS NGYNYLD | 2741 | LASNRAS | 3435 | CMQGLQPPFTF | 4129 | hFzd9, mFzd9 |
| 050S-E12 | hFzd9L | RASQSIYRW LZ | 2742 | SASTIES | 3436 | CQQAYSTPLTF | 4130 | hFzd9, mFzd9 |
| 050S-F12 | hFzd9L | RAZQGISNN LN | 2743 | AASSLQS | 3437 | CQQANSFPPTF | 4131 | hFzd9, mFzd9 |
| 050S-G12 | hFzd9L | RASQSIYRW LA | 2744 | SAS7LES | 3438 | CQQAYSTPLTF | 4132 | hFzd9, mFzd9 |
| 051S-A01 | hFzd9L | RASQGISIY LA | 2745 | SASNLQS | 3439 | CQQAYSFPFTF | 4133 | hFzd9, mFzd9 |
| 051S-B01 | hFzd9L | KSSQSVLYS SNNKNYLA | 2746 | WASTRES | 3440 | CQQYYSTPLTF | 4134 | hFzd9, mFzd9 |
| 051S-C01 | hFzd9L | RASQSISSW LA | 2747 | AASNLEI | 3441 | CQQSYSTPFTF | 4135 | hFzd9, mFzd9 |
| 051S-E01 | hFzd9L | RASQSIGSW LA | 2748 | AASSLQS | 3442 | CQQSYNTPYTF | 4136 | hFzd9, mFzd9 |
| 051S-F01 | hFzd9L | RASQSITRW LA | 2749 | DASTLQS | 3443 | CQQSYSTPLTF | 4137 | hFzd9, mFzd9 |
| 051S-G01 | hFzd9L | KSSQSVLYS SNNKNYLA | 2750 | WASTRQS | 3444 | CQQYYGVPLTF | 4138 | hFzd9, mFzd9 |
| 051S-H01 | hFzd9L | RSSQSLLHS NGYNYLD | 2751 | LGSNRAS | 3445 | CMQALQPPFTF | 4139 | hFzd9, mFzd9 |
| 051S-AQ2 | hFzd9L | RSSQSLLHS NGYNYLD | 2752 | QGSRRAP | 3446 | CMQGTHWPITF | 4140 | hFzd9, mFzd9 |
| 046S-C02 | hFzd10L | QASQDISNY LN | 2753 | SASSLQS | 3447 | CQQSYSTPFTF | 4141 | hFzd10L, mFzd10L |
| 046S-E02 | hFzd10L | RASQSISRW LA | 2754 | AASSLQS | 3448 | CLQDYSYPLTF | 4142 | hFzd10L, mFzd10L |
| 046S-H02 | hFzd10L | RSSQSLLHS NGYNYLD | 2755 | AASSLQS | 3449 | CMQGLQTPYTF | 4143 | hFzd10L, mFzd10L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 046S-A03 | hFzd10L | RASQSISSY LN | 2756 | ATATLNS | 3450 | CQQGYNIPFTF | 4144 | hFzd10L, mFzd10L |
| 046S-F03 | hFzd10L | RSSQSLLHS NGYNYLD | 2757 | DASNLEA | 3451 | CMQTTHWPWTF | 4145 | hFzd10L, mFzd10L |
| 046S-B04 | hFzd10L | RSSQSLLHS NGYNYLD | 2758 | DASSLES | 3452 | CMQGLQTPWAF | 4146 | hFzd10L, mFzd10L |
| 046S-A05 | hFzd10L | RASQSISTW LA | 2759 | AASTLQS | 3453 | CQQAYGFPPTF | 4147 | hFzd10L, mFzd10L |
| 046S-G01 | hFzd10L | RASQGISSY LA | 2760 | GASTLHS | 3454 | CQQSYNSPPTF | 4148 | hFzd10L |
| 046S-A02 | hFzd10L | RSSQSLLHS NGYNYLD | 2761 | KASSLES | 3455 | CMQGLEAPITF | 4149 | hFzd10L |
| 046S-B03 | hFzd10L | RSSQSLLHS NGYNYLD | 2762 | DASNLGT | 3456 | CMQALQTPPTF | 4150 | hFzd10L |
| 046S-A04 | hFzd10L | RSSQSLLHS NGYNYLD | 2763 | LGSNRAS | 3457 | CMQALQSPITF | 4151 | hFzd10L |
| 046S-C05 | hFzd10L | RASQSISSW LA | 2764 | DASSLQS | 3458 | CQKYNSAPFTF | 4152 | hFzd10L, mFzd10L |
| 046S F05 | hFzd10L | RSSQSLLHS NGYNYLD | 2765 | SASNLQS | 3459 | CMQALQTPTF | 4153 | hFzd10L, mFzd10L |
| 046S-A06 | hFzd10L | RASQSISSY LN | 2766 | DASYLEA | 3460 | CQQSYTTPYTF | 4154 | hFzd10L |
| 046S-G06 | hFzd10L | KSSQSVLYS SNNKNYLA | 2767 | WASTRES | 3461 | CQQYYSDPTF | 4155 | hFzd10L, mFzd10L |
| 046S-D07 | hFzd10L | RSSQSLLHS NGYNYLD | 2768 | LGSSRAS | 3462 | CMQALQAPPTF | 4156 | hFzd10L |
| 046S E07 | hFzd10L | RASQGISSY LA | 2769 | AASSLQS | 3463 | CQQSYSTPLTF | 4157 | hFzd10L |
| 046S-F07 | hFzd10L | RSSQSLLHS NGYNYLD | 2770 | LGSDRAS | 3464 | CMQALQTPITF | 4158 | hFzd10L, mFzd10L |
| 046S-G07 | hFzd10L | RSSQSLLHS NGYNYLD | 2771 | LGSDRAS | 3465 | CMQALQTPITF | 4159 | hFzd10L, mFzd10L |
| 046S-H07 | hFzd10L | RASQSISSW LA | 2772 | DASNLET | 3466 | CQQYDSYPLTF | 4160 | hFzd10L, mFzd10L |
| 046S-E08 | hFzd10L | RSSQSLLHS NGYNYLD | 2773 | SGSNRAS | 3467 | CMQALQTPLTF | 4161 | hFzd10L, mFzd10L |
| 046S-G08 | hFzd10L | KSSQSVLYS SNNKNYLA | 2774 | WASTRES | 3468 | CQQYYSDPITF | 4162 | hFzd10L |
| 046S-A09 | hFzd10L | RASQSISSW LA | 2775 | AASTLQS | 3469 | CLQDYNYPLTF | 4163 | hFzd10L |
| 046S-F09 | hFzd10L | QASQDISNY LN | 2776 | GASSLQS | 3470 | CQQSYSSPTTF | 4164 | hFzd10L |
| 046S-D10 | hFzd10L | RSSQSLLHS NGYNYLD | 2777 | LGSNRAS | 3471 | CMQGTHWPVTF | 4165 | hFzd10L, mFzd10L |
| 046S-F10 | hFzd10L | RASQSISSW LA | 2778 | AASSLQS | 3472 | CQQANNYPITF | 4166 | hFzd10L, mFzd10L |
| 046S-G10 | hFzd10L | RASQSISRW LA | 2779 | GASTRAT | 3473 | CQQYDSYPITF | 4167 | hFzd10L, mFzd10L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 046S-D11 | hFzd10L | RASQGISNY LA | 2780 | AASTLQS | 3474 | CQQGYSTPLTF | 4168 | hFzd10L, mFzd10L |
| 046S-F11 | hFzd10L | RASQSISSY LN | 2781 | DASNLET | 3475 | CQQSYSIPITF | 4169 | hFzd10L, mFzd10L |
| 046S-G11 | hFzd10L | RSSQSLLHS NGYNYLD | 2782 | LGSNRAS | 3476 | CMQALQTPLTF | 4170 | hFzd10L |
| 046S-E12 | hFzd10L | RSSQSLLHS NGYNYLD | 2783 | LGSNRAS | 3477 | CMQALETPTF | 4171 | hFzd10L, mFzd10L |
| 046S-G12 | hFzd10L | RSSQSLLHS NGYNYLD | 2784 | LGSDRAS | 3478 | CLQGTHWPPTF | 4172 | hFzd10L, mFzd10L |
| 047S-A01 | hFzd10L | RSSQSLLHS NGYNYLD | 2785 | LGSNRAS | 3479 | CMQALETPLTF | 4173 | hFzd10L, mFzd10L |
| 047S-B01 | hFzd10L | RSSQSLLHS NGYNYLD | 2786 | EASTLEH | 3480 | CMQALQTPYTF | 4174 | hFzd10L |
| 047S-E01 | hFzd10L | RSSQSLLHS NGYNYLD | 2787 | DASSLET | 3481 | CMQALQTPPTF | 4175 | hFzd10L, mFzd10L |
| 047S-A02 | hFzd10L | RASQSISSY LN | 2788 | DASNLET | 3482 | CQQSYSTPLTF | 4176 | hFzd10L |
| 047S-C02 | hFzd10L | QASQDISNY LN | 2789 | AASSLQS | 3483 | CQQYYSTPLTF | 4177 | hFzd10L |
| 047S-E02 | hFzd10L | RASQSISSW LA | 2790 | DASTLQS | 3484 | CQQSYDIPITF | 4178 | hFzd10L, mFzd10L |
| 047S-F02 | hFzd10L | RASQGISSW LA | 2791 | DASNLDA | 3485 | CQQVNSFPLTF | 4179 | hFzd10L, mFzd10L |
| 047S-F03 | hFzd10L | RSSQSLLHS NGYNYLD | 2792 | EVSNRAS | 3486 | CMQALQTPPTF | 4180 | hFzd10L, mFzd10L |
| 047S-G03 | hFzd10L | RASQSISSY LN | 2793 | AASSLQS | 3487 | CQQSYNTPLTF | 4181 | hFzd10L |
| 047S-D04 | hFzd10L | RSSQSLLHS NGYNYLD | 2794 | AASTLES | 3488 | CMQALQTPLTF | 4182 | hFzd10L, mFzd10L |
| 047S-E04 | hFzd10L | RASQGISNY LA | 2795 | DASNLET | 3489 | CQQTYTIPLTF | 4183 | hFzd10L |
| 047S-H04 | hFzd10L | RASQSISSW LA | 2796 | GASNLQS | 3490 | CQQYAASPSSF | 4184 | hFzd10L, mFzd10L |
| 047S-C05 | hFzd10L | RSSQSLLHS NGYNYLD | 2797 | AASSLQS | 3491 | CMQALEAPITF | 4185 | hFzd10L |
| 047S-E05 | hFzd10L | RSSQSLLHS NGYNYLD | 2798 | SGSNRAS | 3492 | CMQATHWPWTF | 4186 | hFzd10L, mFzd10L |
| 047S-F05 | hFzd10L | RASQSISSW LA | 2799 | PGNILQG | 3493 | CQQTYSTPYTF | 4187 | hFzd10L, mFzd10L |
| 047S-G05 | hFzd10L | RASQSISTY LN | 2800 | GASNVQS | 3494 | CQQTYTIPITF | 4188 | hFzd10L, mFzd10L |
| 047S-C06 | hFzd10L | RSSQSLLHS NGYNYLD | 2801 | EASSIAS | 3495 | CMQALQTPLTF | 4189 | hFzd10L, mFzd10L |
| 047S-E06 | hFzd10L | RSSQSLLHS NGYNYLD | 2802 | LGSNRAS | 3496 | CMQALQTPPTF | 4190 | hFzd10L, mFzd10L |
| 047S-F06 | hFzd10L | RASQSISSW LA | 2803 | KASTLDS | 3497 | CQQGYNIPFTF | 4191 | hFzd10L, mFzd10L |

TABLE 2-continued

Clone IDs and CDR sequences for hinge specific ("L") or hinge (L) + CRD
("ext") binders. "CDRH" indicates heavy chain CDRs, and "CDRL" indicates
light chain CDRs.

| Clone ID | Antigen | CDRH1 | CDRH1 SEQ ID | CDRH2 | CDRH2 SEQ ID | CDRH3 | CDRH3 SEQ ID | ELISA specificity |
|---|---|---|---|---|---|---|---|---|
| 047S-G06 | hFzd10L | RASQGISNY LA | 2804 | AASSLQS | 3498 | CLQHKKYPLTF | 4192 | hFzd10L, mFzd10L |
| 047S-A07 | hFzd10L | RSSQSLLHS NGYNYLD | 2805 | LGSNRAS | 3499 | CMQALQTPLTF | 4193 | hFzd10L, mFzd10L |
| 047S-B07 | hFzd10L | RSSQSLLHS NGYNYLD | 2806 | LGSNRAS | 3500 | CMQGLQSPVTF | 4194 | hFzd10L |
| 047S-C07 | hFzd10L | RASQSISTY LN | 2807 | AASTLHS | 3501 | CQQANSFPLTF | 4195 | hFzd10L, mFzd10L |
| 047S-F07 | hFzd10L | QASQDISNY LN | 2808 | DASNLET | 3502 | CQQSYNTPYTF | 4196 | hFzd10L, mFzd10L |
| 047S-G07 | hFzd10L | RASQGISSW LA | 2809 | DVSTLQS | 3503 | CQQGYSTPLTF | 4197 | hFzd10L |
| 047S-H07 | hFzd10L | RSSQSLLHS NGYNYLD | 2810 | LGSNRAS | 3504 | CMQALQTPLTF | 4198 | hFzd10L, mFzd10L |
| 047S-A08 | hFzd10L | RASQSISSW LA | 2811 | GASNLQS | 3505 | CQHYAASPSSF | 4199 | hFzd10L, mFzd10L |
| 047S-C08 | hFzd10L | KSSQSVLYS SNNKNYLA | 2812 | WASTRES | 3506 | CQQYYDTPYTF | 4200 | hFzd10L, mFzd10L |
| 047S-D03 | hFzd10L | RSSQSLLHS NGYNYLD | 2813 | LGSNRAS | 3507 | CMQALQVPLTF | 4201 | hFzd10L, mFzd10L |
| 047S-B11 | hFzd10L | RSSQSLLHS NGYNYLD | 2814 | SGSNRAS | 3508 | CMQALQTPFTF | 4202 | hFzd10L, mFzd10L |
| 047S-E12 | hFzd10L | RSSQSLLHS NGYNYLD | 2815 | LGSNRAS | 3509 | CMQGSHWPLTF | 4203 | hFzd10L, mFzd10L |

Example 2

IG Construction and Binding Affinity
Determination

Certain VL and VH clones from Table 1 were PCR amplified from the phage clone and sub-cloned into pcDNA3.1 based mammalian expression vectors (Invitrogen/ThermoFisher) of human kappa or lambda light chain and human IgG1 heavy chain, respectively. Candidate IgGs were purified using Protein A affinity resin. The candidate library was captured on an anti-FC lawn. The capture lawn was prepared by direct amine coupling goat anti-human IgG Fc (Southern Biotech #2048-01) at 8000 RU on a HC200M Carterra sensor chip (Carterra 4297). Capture levels were at least 600 RU for each candidate IgG. Binding to all target peptides was measured at 25° by injecting a concentration series of each peptide in 1×PBST+0.5 mg/mL BSA (TEKnova P1192, VWR V0332). All peptides were injected at 4.12 nM, 12.3 nM, 37 nM, 111 nM, 333 nM, and 1000 nM. Two blank injections were run between each peptide concentration series. Each injection started with a one minute baseline determination, followed by a five minute association phase where peptides were injected, and finished with a 10 minute dissociation phase. Binding data was analyzed using NextGenKIT (Carterra). Blank injections and reference locations were subtracted from all runs prior to fitting a 1:1 binding model to the data. Table 3 shows the results following analysis on the Carterra LSA microfluidic surface plasmon resonance detection instrument (Carterra, Salt Lake City, Utah). Interactions with an $R_{max}$ less than 15 RU or weaker than 5 μM were considered non-binders.

TABLE 3

Binding of monospecific Fzd clones.

| Name | Target | Fzd1 Hu/Mo | Fzd2 Hu/Mo | Fzd3 Hu/Mo | Fzd4 Hu/Mo | Fzd5 Hu/Mo | Fzd6 Hu/Mo | Fzd7 Hu/Mo | Fzd8 Hu/Mo | Fzd9 Hu/Mo | Fzd10 Hu/Mo |
|---|---|---|---|---|---|---|---|---|---|---|---|
| 033S-A01 | Fzd1L | */** | —/— | —/— | —/— | —/— | —/— | —/— | NT/— | —/— | —/— |
| 033S-B01 | Fzd1L | / | —/— | —/— | —/— | —/— | —/— | —/— | NT/— | —/— | —/— |
| 033S-C01 | Fzd1L | / | —/— | —/— | —/— | —/— | —/— | —/— | NT/— | —/— | —/— |
| 033S-D01 | Fzd1L | */** | —/— | —/— | —/— | —/— | —/— | —/— | NT/— | —/— | —/— |
| 033S-E01 | Fzd1L | / | —/— | —/— | —/— | —/— | —/— | —/— | NT/— | —/— | —/— |
| 033S-H01 | Fzd1L | */** | —/— | —/— | —/— | —/— | —/— | —/— | NT/— | —/— | —/— |
| 033S-B02 | Fzd1L | / | —/— | —/— | —/— | —/— | —/— | —/— | NT/— | —/— | —/— |

TABLE 3-continued

Binding of monospecific Fzd clones.

| Name | Target | Fzd1 Hu/Mo | Fzd2 Hu/Mo | Fzd3 Hu/Mo | Fzd4 Hu/Mo | Fzd5 Hu/Mo | Fzd6 Hu/Mo | Fzd7 Hu/Mo | Fzd8 Hu/Mo | Fzd9 Hu/Mo | Fzd10 Hu/Mo |
|---|---|---|---|---|---|---|---|---|---|---|---|
| 033S-C02 | Fzd1L | / | —/— | —/— | —/— | —/— | —/— | —/— | NT/— | —/— | —/— |
| 033S-D02 | Fzd1L | / | —/— | —/— | —/— | —/— | —/— | —/— | NT/— | —/— | —/— |
| 033S-E02 | Fzd1L | */* | —/— | —/— | —/— | —/— | —/— | —/— | NT/— | —/— | —/— |
| 033S-F02 | Fzd1L | / | —/— | —/— | —/— | —/— | —/— | —/— | NT/— | —/— | —/— |
| 033S-G02 | Fzd1L | / | —/— | —/— | —/— | —/— | —/— | —/— | NT/— | —/— | —/— |
| 033S-H03 | Fzd1L | **/— | —/— | —/— | —/— | —/— | —/— | —/— | NT/— | —/— | —/— |
| 033S-A03 | Fzd1L | */* | —/— | —/— | —/— | —/— | —/— | —/— | NT/— | —/— | —/— |
| 033S-B03 | Fzd1L | **/** | —/— | —/— | —/— | —/— | —/— | —/— | NT/— | —/— | —/— |
| 033S-C03 | Fzd1L | / | —/— | —/— | —/— | —/— | —/— | —/— | NT/— | —/— | —/— |
| 033S-D03 | Fzd1L | */** | —/— | —/— | —/— | —/— | —/— | —/— | NT/— | —/— | —/— |
| 034S-C01 | Fzd1L | **/* | —/— | —/— | —/— | —/— | —/— | —/— | NT/— | —/— | —/— |
| 033S-E03 | Fzd1L | */* | —/— | —/— | —/— | —/— | —/— | —/— | NT/— | —/— | —/— |
| 034S-F01 | Fzd1L | */* | —/— | —/— | —/— | —/— | —/— | —/— | NT/— | —/— | —/— |
| 034S-H01 | Fzd1L | / | —/— | —/— | —/— | —/— | —/— | —/— | NT/— | —/— | —/— |
| 037S-H01 | Fzd1L | / | —/— | —/— | —/— | —/— | —/— | —/— | NT/— | —/— | —/— |
| 48SH1 | Fzd2L | —/— | /* | —/— | —/— | —/— | —/— | —/— | NT/— | —/— | —/— |
| 031S-G01 | Fzd2L | —/— | **/— | —/— | —/— | —/— | —/— | —/— | NT/— | —/— | —/— |
| 037S-G02 | Fzd2L | —/— | / | —/— | —/— | —/— | —/— | —/— | NT/— | —/— | —/— |
| 037S-D03 | Fzd2L | —/— | **/— | —/— | —/— | —/— | —/— | —/— | NT/— | —/— | —/— |
| 037S-F05 | Fzd2L | —/— | —/** | —/— | —/— | —/— | —/— | —/— | NT/— | —/— | —/— |
| 49SC1 | Fzd2L | —/— | */* | —/— | —/— | —/— | —/— | —/— | NT/— | —/— | —/— |
| 49SD1 | Fzd2L | —/— | **/— | —/— | —/— | —/— | —/— | —/— | NT/— | —/— | —/— |
| 44SE1 | Fzd3L | —/— | —/— | / | —/— | —/— | —/— | —/— | NT/— | —/— | —/— |
| 44SA2 | Fzd3L | —/— | —/— | */ | —/— | —/— | —/— | —/— | NT/— | —/— | —/— |
| 44SC2 | Fzd3L | —/— | —/— | / | —/— | —/— | —/— | —/— | NT/— | —/— | —/— |
| 44SD2 | Fzd3L | —/— | —/— | / | —/— | —/— | —/— | —/— | NT/— | —/— | —/— |
| 44SE2 | Fzd3L | —/— | —/— | / | —/— | —/— | —/— | —/— | NT/— | —/— | —/— |
| 44SF3 | Fzd3L | —/— | —/— | */ | —/— | —/— | —/— | —/— | NT/— | —/— | —/— |
| 44SG3 | Fzd3L | —/— | —/— | */ | —/— | —/— | —/— | —/— | NT/— | —/— | —/— |
| 44SA10 | Fzd3L | / | —/— | —/— | —/— | —/— | —/— | —/— | NT/— | —/— | —/— |
| 45SE4 | Fzd3L | —/— | —/— | —/** | —/— | —/— | —/— | —/— | NT/— | —/— | —/— |
| 44SF1 | Fzd3L | —/— | —/— | **/— | —/— | —/— | —/— | —/— | NT/— | —/— | —/— |
| 44SD3 | Fzd3L | —/— | —/— | **/— | —/— | —/— | —/— | —/— | NT/— | —/— | —/— |
| 44SG9 | Fzd3L | —/— | —/— | */ | —/— | —/— | —/— | —/— | NT/— | —/— | —/— |
| 39SC12 | Fzd4L | —/— | —/— | —/— | —/** | —/— | —/— | —/— | NT/— | —/— | —/— |
| 39SF11 | Fzd4L | / | —/— | —/— | —/— | —/— | —/— | —/— | NT/— | —/— | —/— |
| 40SF1 | Fzd4L | */* | —/— | —/— | —/— | —/— | —/— | —/— | NT/— | —/— | —/— |
| 40SE1 | Fzd4L | **/** | —/— | —/— | —/— | —/— | —/— | —/— | NT/— | —/— | —/— |
| 40SG2 | Fzd4L | —/— | —/— | —/— | —/— | —/— | —/— | —/— | NT/— | —/— | —/— |
| 40SF4 | Fzd4L | —/* | —/— | —/— | —/— | —/— | —/— | —/— | NT/— | —/— | —/— |
| 38SG1 | Fzd4L | —/— | —/— | —/— | */* | —/— | —/— | —/— | NT/— | —/— | —/— |
| 38SH3 | Fzd4L | —/— | —/— | —/— | / | —/— | —/— | —/— | NT/— | —/— | —/— |
| 36SB1 | Fzd5L | —/— | —/— | —/— | —/— | —/— | —/— | —/— | NT/— | —/— | —/— |
| 36SC1 | Fzd5L | —/— | —/— | —/** | —/— | —/— | —/— | —/— | NT/— | —/— | —/— |
| 36SF4 | Fzd5L | —/— | —/— | —/— | —/— | ***/— | —/— | —/— | NT/— | —/— | —/— |
| 36SB4 | Fzd5L | —/— | —/— | —/— | —/— | **/— | —/— | —/— | NT/— | —/— | —/— |
| 36SG4 | Fzd5L | —/— | —/— | —/— | —/— | **/— | —/— | —/— | NT/— | —/— | —/— |
| 36SE1 | Fzd5L | —/— | —/— | —/— | —/— | **/— | —/— | —/— | NT/— | —/— | —/— |
| 41SG5 | Fzd6L | */* | —/— | —/— | —/— | —/— | —/— | —/— | NT/— | —/— | —/— |
| 41SA10 | Fzd6L | —/— | —/— | —/— | —/— | —/— | **/— | —/— | NT/— | —/— | —/— |
| 41SB3 | Fzd6L | —/— | —/— | —/— | —/— | —/— | **/— | —/— | NT/— | —/— | —/— |
| 41SB5 | Fzd6L | —/— | —/— | —/— | —/— | —/— | */ | —/— | NT/— | —/— | —/— |
| 41SB1 | Fzd6L | —/— | —/— | —/— | —/— | —/— | —/* | —/— | NT/— | —/— | —/— |
| 40SB12 | Fzd6L | —/— | —/— | —/— | —/— | —/— | */* | —/— | NT/— | —/— | —/— |
| 41SB5 | Fzd6L | —/— | —/— | —/— | —/— | —/— | / | —/— | NT/— | —/— | —/— |
| 40SB10 | Fzd6L | —/— | —/— | —/— | —/— | —/— | / | —/— | NT/— | —/— | —/— |
| 40SG10 | Fzd6L | —/— | —/— | —/— | —/— | —/— | —/** | —/— | NT/— | —/— | —/— |
| 40SG7 | Fzd6L | —/— | —/— | —/* | —/— | —/— | —/— | —/— | NT/— | —/— | —/— |
| 49SB2 | Fzd7L | —/— | —/— | —/— | —/— | —/— | —/— | ***/— | NT/— | —/— | —/— |
| 49SD2 | Fzd7L | —/— | —/— | —/— | —/— | —/— | —/— | */ | NT/— | —/— | —/— |
| 49SE2 | Fzd7L | —/— | —/— | —/— | —/— | —/— | —/— | / | NT/— | —/— | —/— |
| 49SH2 | Fzd7L | —/— | —/— | —/— | —/— | —/— | —/— | */* | NT/— | —/— | —/— |
| 49SA3 | Fzd7L | —/— | —/— | —/— | —/— | —/— | —/— | / | NT/— | —/— | —/— |
| 49SD3 | Fzd7L | —/— | —/— | —/— | —/— | —/— | —/— | /* | NT/— | —/— | —/— |
| 49SG3 | Fzd7L | —/— | —/— | —/— | —/— | —/— | —/— | **/— | NT/— | —/— | —/— |
| 49SA4 | Fzd7L | —/— | —/— | —/— | —/— | —/— | —/— | / | NT/— | —/— | —/— |
| 32SH2 | Fzd7L | —/— | —/— | —/— | —/— | —/— | —/— | / | NT/— | —/— | —/— |
| 32SF2 | Fzd7L | —/— | —/— | —/— | —/— | —/— | —/— | **/— | NT/— | —/— | —/— |

TABLE 3-continued

| | | Fzd1 Hu/Mo | Fzd2 Hu/Mo | Fzd3 Hu/Mo | Fzd4 Hu/Mo | Fzd5 Hu/Mo | Fzd6 Hu/Mo | Fzd7 Hu/Mo | Fzd8 Hu/Mo | Fzd9 Hu/Mo | Fzd10 Hu/Mo |
|---|---|---|---|---|---|---|---|---|---|---|---|
| Name | Target | | | | | | | | | | |
| 32SD2 | Fzd7L | —/— | —/— | —/— | —/— | —/— | —/— | */* | NT/— | —/— | —/— |
| 50SD10 | Fzd9L | —/— | —/— | **/* | —/— | —/— | —/— | —/— | NT/— | —/— | —/— |
| 50SA11 | Fzd9L | —/— | —/— | —/— | —/— | —/— | —/— | —/— | NT/— | */** | —/— |
| 50SG11 | Fzd9L | —/— | —/— | —/— | —/— | —/— | —/— | —/— | NT/— | / | —/— |
| 46SF1 | Fzd10L | */** | —/— | —/— | —/— | —/— | —/— | —/— | NT/— | —/— | —/— |
| 46SB2 | Fzd10L | / | —/— | —/— | —/— | —/— | —/— | —/— | NT/— | —/— | —/— |
| 46SC2 | Fzd10L | / | —/— | —/— | —/— | —/— | —/— | —/— | NT/— | —/— | —/— |
| 46SE2 | Fzd10L | —/— | —/— | —/— | —/— | —/— | —/— | —/— | NT/— | —/— | —/*** |
| 46SG2 | Fzd10L | —/* | —/— | —/— | —/— | —/— | —/— | —/— | NT/— | —/— | —/— |
| 46SH4 | Fzd10L | —/— | —/— | —/— | —/— | —/— | —/— | —/— | NT/— | —/— | **/* |
| 047S-D05 | Fzd10L | —/— | —/— | —/— | —/— | —/— | —/— | —/— | NT/— | —/— | */ |
| 46SF2 | Fzd10L | —/— | —/— | —/— | —/— | —/— | —/— | —/— | NT/— | —/— | / |
| 46SF3 | Fzd10L | —/— | —/— | —/— | —/— | —/— | —/— | —/— | NT/— | —/— | **/— |
| 46SF4 | Fzd10L | —/— | —/— | —/— | —/— | —/— | —/— | —/— | NT/— | —/— | / |
| 47SG6 | Fzd10L | —/— | —/— | —/— | —/— | —/— | —/— | —/— | NT/— | —/— | **/— |
| 46SB1 | Fzd10L | —/— | —/— | —/— | —/— | —/— | —/— | —/— | NT/— | —/— | / |

NT = Not Tested;

— = No Binding;

* = KD > 1 uM; * = KD > 1 uM;

** = 1 uM > KD > 100 nM;

*** = 100 nM > KD > 10 nM;

**** = 10 nM > KD

Example 3

Expression and Purification of Fab Binder

Plasmids expressing light-chain and heavy-chain (with hexa-histidine tag at its C-terminus) of a Fab binder against mouse Fzd8 hinge region (15G4-4) or human Fzd8 CRD (027S-E5) was co-transfected for co-expression in Expi293 cells, following the standard protocols from the manufacturer (ThermoFisher). After 4 days of continuous cell growth, media were harvested by centrifugation, and bound to Complete-His resin (2.5 mL per 1 L culture; Roche) pre-equilibrated in PBS, and eluted under gravity-flow using 250 mM imidazole in PBS. Elutions containing the Fab binder were concentrated to ~5 mL, and further polished on a HiLoad 16/600 Superdex 200 pg column (GE Life Sciences) column pre-equilibrated with HBS. Fractions near main peak were further analyzed by SDS-Polyacrylamide Gel Electrophoresis (SDS-PAGE) to confirm the content. SDS-PAGE was performed using Tris-HCl 4-15% gel (Bio-Rad, Hercules, Calif.) under both reducing and non-reducing conditions. The samples were prepared in Laemmli sample buffer and heated at 100° C. for 5 min. Fractions containing 15G4-4 were concentrated to ~3 mg/mL and frozen in the presence of 10% glycerol for storage at ~80° C. until further use. Protein concentrations were determined using a Nano-Drop Spectrophotometer (Thermo Scientific) by the direct UV A280 method. The relationship of absorbance to protein concentration is linear based on Beer-Lamber equation, $A=\varepsilon$ l c; A is the absorbance value, $\varepsilon$ is the wavelength-dependent extinction coefficient, l is the path length in centimeters, and c is the protein concentration. The extinction coefficients of all produced proteins were estimated by their amino acid sequences.

Example 4

Fab Binding Affinities

Binding kinetics of clone 027S-E5 specific to the Fzd cysteine rich domain (CRD) of human Fzd8, was determined by bio-layer interferometry (BLI) using Octet Red 96 (PALL ForteBio, Fremont, Calif.) instruments at 30° C., 1000 rpm with streptavidin (SA) biosensors. C-terminal biotinylated Fzd CRD recombinant protein was diluted to 20 nM in the running buffer (PBS, 0.05% Tween-20, 0.5% BSA, pH 7.2) and captured to the SA biosensor until coupling length reached 0.2 nm. Following capture of the Fzd CRD, the SA biosensor with captured biotinylated-Fzd CRD was dipped into wells containing the relevant antibody fragment at 7 different concentrations (0, 1.37, 4.12, 12.4, 37, 111.1, 333.3, 1000 nM) in running buffer, plus a well with only running buffer as a reference channel. $K_D$ was determined by global fitting, 1:1 binding model according to manufacturer recommended settings.

Candidate Fab (15G4-4) was purified by nickel affinity resin. Biotinylated target peptides were captured on a NeutrAvidin lawn. The capture lawn was prepared by direct amine coupling NeutrAvidin (ThermoFisher 31000) to a CMDP Carterra sensor chip. Binding was measured by injecting the Fabs at 4.12 nM, 12.3 nM, 37 nM, 111 nM, 333 nM, and 1000 nM. Each injection started with a one minute baseline determination, followed by a five minute association phase where peptides were injected, and finished with a 10 minute dissociation phase. Binding data was analyzed using NextGenKIT (Carterra). Blank injections and reference locations were subtracted from all runs prior to fitting a 1:1 binding model to the data. Interactions with an $R_{max}$ less than 15 RU or weaker than 5 μM were considered non-binders. Table 4 provides the binding affinities for 15G4-4 and 027S-E5.

TABLE 4

| | | Fzd1 H/M | Fzd2 H/M | Fzd3 H/M | Fzd4 H/M | Fzd5 H/M | Fzd6 H/M | Fzd7 H/M | Fzd8 H/M | Fzd9 H/M | Fzd10 H/M |
|---|---|---|---|---|---|---|---|---|---|---|---|
| | | | | | Binding Affinity of FZD8 Fab clones | | | | | | |
| Name | Target | | | | | | | | | | |
| 15G4-4 | mFzd8 | —/— | —/— | —/— | —/— | —/— | —/— | —/— | NT/** | —/— | —/— |
| 027S-E5 | hFzd8 (CRD) | —/— | —/— | —/— | —/— | —/— | —/— | —/— | ***/NT | —/— | —/— |

NT Not Tested
— No Binding
\* KD ≥ i uM
\*\* 1 uM > KD ≥ 100 nM
\*\*\* 100 nM > KD ≥ 10 nM
\*\*\*\* 10 nM > KD

Example 5

Crystal Structures of Anti-Fzd Antibody Fragments Bound to Fzd Extra-Cellular Domains Fzds are a class of GPCRs in which an extra-cellular Cys-rich domain (CRD) is connected to its 7-transmember-ane helical domain and cytoplasmic tail through a linker region. Fzds have either one or two predicted -NxS/T-glycosylation motifs within their extra-cellular domain. To enable high-resolution structures, Fzds extra-cellular domains that contain two glycosylation motifs were trun-cated before second predicted -NxS/T- glycosylation motifs resulting constructs named CRD-Xtal. Sequence of each of 10 Fzd CRD-Xtal containing an eight-Histidine motif at their C-terminus are as follows:

```
hFzd8_Q9H461_28-153
                                      (SEQ ID NO: 11)
ASAKELACQEITVPLCKGIGYNYTYMPNQFNHDTQDEAGLEVHQFWPLV
EIQCSPDLKFFLCSMYTPICLEDYKKPLPPCRSVCERAKAGCAPLMRQY
GFAWPDRMRCDRLPEQGNPDTLCMDYNRHHHHHHHH
```

Example 6

Expression and Purification of FZD8-CRD Protein

FreeStyle™ 293-F Cells (Thermofisher) stably expressing all Fzd8-CRD was created using lenti-viral technology. For large-scale expression, a frozen vial FreeStyle™ 293-F Cells expressing Fzd8-CRD was thawed into 20 mL of FreeStyle (Thermofisher) media in the presence of 10 U penicillin and 10 ug of streptomycin (Lonza) per mL. Cells were expended on alternative days, until density of ~3.0×10⁶ cell/mL was reached at desired volumes, typically 5 to 10 L. At this stage, cells were allowed to grow continuously to higher density and, media was harvested by centrifugation at a viability of ~70%. Fzd8-CRD protein was purified from media by incubation with Ni-NTA resin (1 mL per L of culture; Qiagen) pre-equilibrated in HBS (20 mM HEPES pH 7.4, 150 mM NaCl), and washed sequentially with 10 CV (column volume) of HBS, HBS+0.5 mM EDTA, HBS, HBS+500 mM sodium chloride, and HBS. Fzd8-CRD was eluted with 10 CV of 500 mM imidazole in HBS using a gravity-flow glass-column. Ni-NTA eluates were concen-trated to 5 mL, and further polished on a HiLoad 16/600 Superdex 200 pg column (GE Life Sciences) pre-equili-brated with HBS. Fractions near the main peak was further analyzed by SDS-Polyacrylamide Gel Electrophoresis (SDS-PAGE; Tris-HCl 4-15% gel Bio-Rad, Hercules, Calif.) to confirm the content. The samples were prepared in Laemmli sample buffer and heated at 100° C. for 5 min. Fractions containing Fzd8-CRD were concentrated to ~3 mg/mL and frozen in the presence of 10% glycerol for storage at −80° C. until further use. Protein concentrations were determined using a NanoDrop Spectrophotometer (Thermo Scientific) by the direct UV A280 method. The relationship of absorbance to protein concentration is linear based on Beer-Lamber equation, $A=\varepsilon\,l\,c$; A is the absorbance value, $\varepsilon$ is the wavelength-dependent extinction coefficient, l is the path length in centimeters, and c is the protein concentration. The extinction coefficients of all produced proteins were estimated by their amino acid sequences.

Example 7

Expression and Purification of Fab-Domain of Anti-Fzd8 Anti-Body 27SE5

Plasmids expressing light-chain and heavy-chain (with hexa-histidine tag at its C-terminus) of Fab-domain of 27SE5 were transfected for expression in Expi293 cells (ThermoFisher USA), typically at 1000 mL scale, using FectoPro transfection agent following standard protocols from the manufacturer (Polyplus Transfection NY USA). After 4 days of continuous cell growth, media were har-vested by centrifugation, and bound to Complete-His resin (2.0 mL per 1 L culture; Roche) pre-equilibrated in 50 mM sodium di-hyrogen phosphate pH 8.0, 300 mM NaCl and eluted under gravity-flow using 250 mM imidazole in the same buffer. Elutions containing Fab binders were concen-trated to ~5 mL, and further polished on a HiLoad 16/600 Superdex 200 pg column (GE Life Sciences) column pre-equilibrated with HBS. Fractions near main peak was further analyzed by SDS-Polyacrylamide Gel Electrophoresis (SDS-PAGE; Tris-HCl 4-15% gel from Bio-Rad, Hercules, Calif.) to confirm the content. The samples were prepared in Laemmli sample buffer and heated at 100° C. for 5 min. Fractions containing 27SE5 Fab were concentrated to −5 mg/mL and frozen in the presence of 10% glycerol for storage at −80 C until further use. Protein concentrations were determined using a NanoDrop Spectrophotometer (Thermo Scientific) by the direct UV A280 method. The relationship of absorbance to protein concentration is linear based on Beer-Lamber equation, $A=\varepsilon\,l\,c$; A is the absorbance value, $\varepsilon$ is the wavelength-dependent extinction coefficient, l is the path length in centimeters, and c is the protein concentration. The extinction coefficients of all produced proteins were estimated by their amino acid sequences.

The sequences of the VH and VL chains of 027S-E5 Fab were as follows:

```
027SE5_SZC02378_VH
                                    (SEQ ID NO: 30)
QVQLEQSGAEVKKPGASVKVSCKASGGTFSSYAISWVRQAPGQGLEWMG

MINPSGGSTTYAQKFQGRVTMTRDTSTSTVYMELSSLRSEDTAVYYCAR

QAGLHCSSTSCYLGNWFDPWGQGTLVTVSSASTKGPSVFPLAPSSKSTS

GGTAALGCLVKDYFPEPVTVSWNSGALTSGVHTFPAVLQSSGLYSLSSV

VTVPSSSLGTQTYICNVNHKPSNTKVDKKVEPKSCGSGSGHHHHHH

027SE5_SZC02377_VL
                                    (SEQ ID NO: 31)
DIQMTQSPSSLSASVGDRVTITCRASQGITKSLAWYQQKPGKAPKLLIY

AASNLATGVPSRFSGSGSGTDFTLTISSLQPEDFATYYCQQYNTFPITF

GQGTRLEIKRTVAAPSVFIFPPSDEQLKSGTASVVCLLNNFYPREAKVQ

WKVDNALQSGNSQESVTEQDSKDSTYSLSSTLTLSKADYEKHKVYACEV

THQGLSSPVTKSFNRGEC
```

Example 8

HuFzd8-CRD:27SE5 Complex Formation, Crystallization, and Structure Determination Purified HuFzd8-CRD and 27SE5 Fab were mixed at 1.1:1 molar ratio (little excess of the HuFzd8-CRD) and incubated with carboxy-peptidase A and B at a w/w ratio of 100:1 for over-night at 4° C. Complex formation was confirmed by observation of a single-major peak on Super-dexS200 Increase (10/300 GL) column pre-equilibrated in HBS. Fractions containing HuFzd8-CRD:27SE5 complex were further checked by SDS-PAGE and concentrated to 36.5 mg/mL for crystallization screens. Initial crystallization screen, using commercially available MCSG1, MCSG2, MCSG3, MCSG4 (Molecular Dimensions USA), PEGs I, and PEGs II (Qiagen USA) screen, and optimization by grid-screens or microseed matrix screen (see, e.g., D'Arcy A, et al. (2014) *Acta Cryst.* F70, 1117-1126) were performed using Mosquito (TTP LabTech) liquid handler and equilibrated at 18° C. inside an EchoTherm incubator (Torrey Pines Scientific USA). 96-well plate crystal screening experiments were periodically monitored manually via a DiscoveryV20 stereomicroscope (Zeiss USA), and crystals were frozen for data collection by plunging into liquid nitrogen in the presence of various cryo-protectants (typically 15 to 30% v/v of glycerol or ethyleneglycol). X-ray diffraction datasets were collected at the Berkeley Center for Structural Biology at the Advanced Light Source (ALS), Berkeley Calif., and processed with XDS (Kabsch W. (2010) *Acta Cryst.* D66:125-132), and xdsme (see, e.g., Legrand P. (2017) https://github.com/legrandp/xdsme DOI 10.5281/zenodo.837885) programs. Structure of HuFzd8-CRD:27SE5 complex was determined by molecular replacement method using Phaser (Phaser crystallographic software), using previously determined structures of HuFzd8-CRD and variable and constant domains of an unrelated Fab at Surrozen Inc, followed by refinement and validation by MolProbity as implemented in Phenix (see, e.g., P. D. Adams, et al. (2010) *Acta Cryst* D66:213-221) and MolProbity (see, e.g., Chen V B, et al. (2010) Acta Cryst. D66:12-21). Crystallography models were manually inspected and built using (see, e.g., Emsleym P (2010) *Acta Cryst.* D66:486-501). Analyses of refined crystal structures, and image creations were performed using MOE (CCG) and PyMol (Schrodinger).

Example 9

Structure of HuFzd8-CRD:27SE5-Fab Complex

Diffraction quality crystals of HuFzd8-CRD:27SE5 complex (concentration=36.5 mg/mL) grew in a crystallization condition containing 1.2 M sodium chloride and 20% (w/v) PEG3350. Crystal was cryo-protected using 16% glycerol in the well-solution. HuFzd8-CRD:27SE5 complex crystallized in the C2221 space group (a=60.63 Å, b=93.23 Å, c=272.437 Å) with one complex molecules per asymmetric unit. Structure of HuFzd8-CRD:27SE5 complex was determined at a resolution of 1.95 Å and refined to $R_{cryst}$ and $R_{free}$ factors of 22.3% and 27.2%, respectively.

Overall structure of HuFzd8-CRD:27SE5 complex is shown in FIGS. 1A and 1B, which revealed that the 27SE5 binds opposite to the lipid binding site as observed in the complex of Fzd8:Wnt8a complex (PDB Code: 4FOA; Janda C Y et al. (2012) *Science* 337: 59-6) and recognizes the C-terminal region of Fzd8. Electron density maps revealed a di-sulfide bond within CDR-H3 between Cys104-Cys109, which interacts with the Asn49, a glycosylation-site on human Fzd8.

Structure of the complex allowed the identification of the epitope on human Fzd8 as well as residue interactions (paratopes) on 027S-E5, as summarized in Table 5. NAG1 (N-acetyl-D-glucosamine) was attached Asn49 of Fzd8.

TABLE 5

| | Interaction Residues for 027S-E05:hFzd8 binding | |
| --- | --- | --- |
| | ≤5Å | >5Å and <8Å |
| Fzd 8 Residues | Gly47, Tyr48, Asn49, Tyr50, Ile95, Cys96, Leu97, Glu98, Asp99, Tyr100, Lys101, Lys102, Leu104, Gln141, Gly142, Asn143, Pro144, Leu147, Cys148, Met149, Asp150, and Tyr151. | Cys35, Gln36, Glu37, Ile38, Thr51, Phe86, Pro105, Cys107, Ser109, Val110, Arg113, Glu140, Asp145, Thr146, and Asn142 |
| 027S-E5 heavy chain residues | Asn52, Pro53, Ser54, Ser57, Thr58, Thr59, Leu102, Cys104, Ser105, Ser106, Thr107, Ser108, Cys109, Tyr110, Leu111, Gly112, and Trp114 | Ser30, Ala33, Trp47, Met50, Ile51, Gly55, Gly56, Tyr60, Ala61, Gln62, Gln65, Gly101, His103, and Asn113 |
| 027S-E05 light chain residues | Ile29, Thr30, Lys31, Ser32, Ala50, Ser52, Asn53, Tyr91, Asn92, Thr93, and Phe94 | Ile2, Gln27, Gly28, Leu33, Ala34, Try49, Ala51, Ser67, Phe71, Gln90, and Pro95 |

Example 10

Monospecific Wnt Surrogate Molecules

Active Whit surrogate molecules were generated comprising various combinations of Fzd binders that bind the Fzd receptor hinge region (see FIG. 1) and LRP binders (see, e.g., WO2019126398, which is incorporated herein, by reference). Three Fab fragment binders that bound to the hinge region of Fzd1 (033S-B03, 033S-D02, and 033S-E02; VLs—SEQ ID NOs:14, 16, and 18; VHs—SEQ ID NOs: 15, 17, and 19) and one Fab fragment binder that bound Fzd2 (031S-B02; VL—SEQ ID NO: 20; VH—SEQ ID NO: 21) were used to demonstrate that binders to the Fzd hinge region yield active Whit surrogate molecules.

Recombinant Fab fragments of these antibodies were produced from Expi293F cells (Thermo Fisher Scientific, Waltham, Mass.) via transient transfection. The Fabs were purified from the culture media with Nickel resin and further polished with size exclusion chromatography (SEC).

Figure 2:
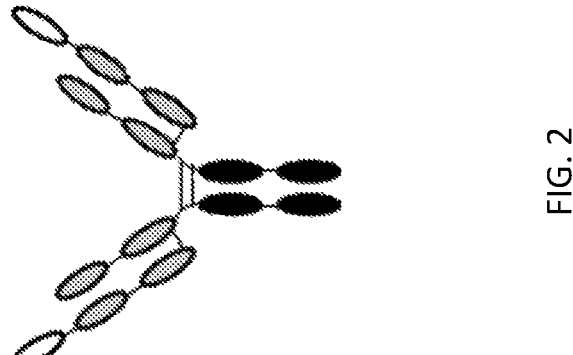
FIG. 2. Illustration of the Wnt surrogate molecule structure. White ovals represent sdAb or VHH binding molecules specific for LRP5, LRP6 or LRP; gray ovals are the mono-specific Fzd Fab binding molecules; and the black ovals are IgG CH2 and CH3 domains. The sdAb or VHH binding molecules are attached to the N-termini of the light chains, with or without a linker.
Figure 4:
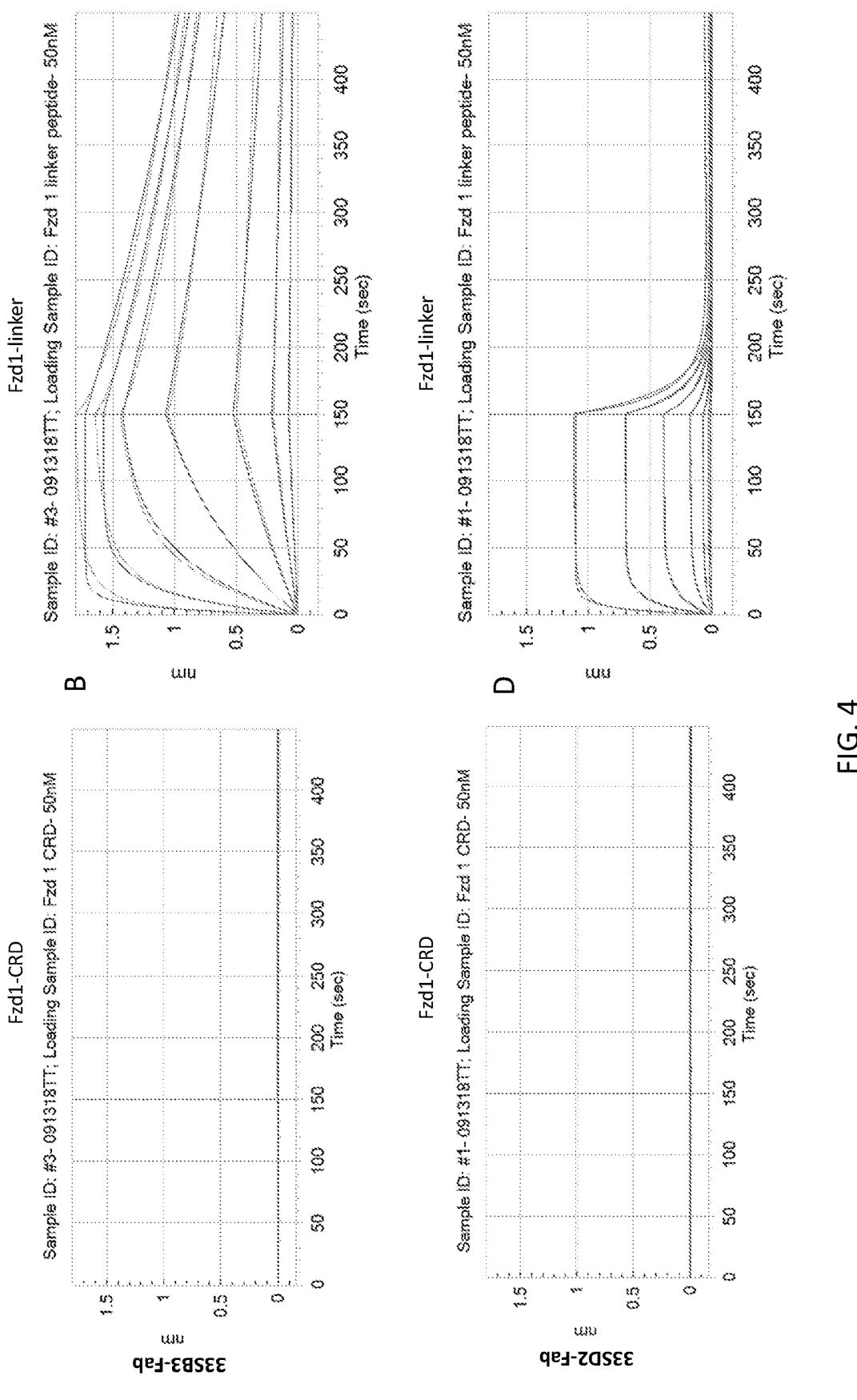
FIGS. 4A-H. Binding kinetics of 33SB3 (FIGS. 4A and 4B), 33SD2 (FIGS. 4C and 4D), 33SE2 (FIGS. 4E and 4F) and 31SB2 (FIGS. 4G and 4H) Fabs.
Figure 4:
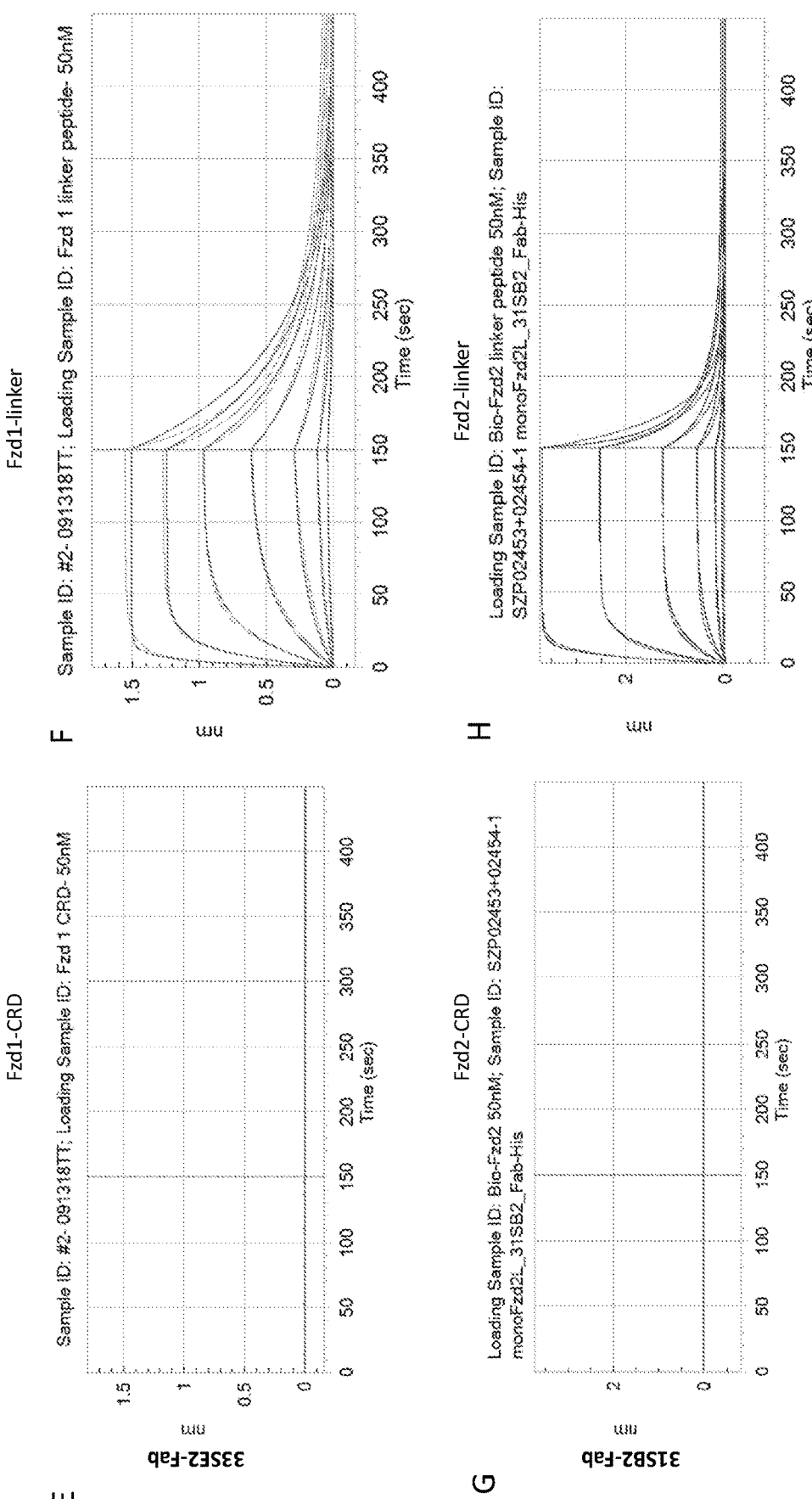

The anti-FZD1 hinge and anti-FZD2 hinge antibodies were cloned into human IgG1 framework with LALA-PG mutations in Fc to reduce effector functions. LRP5 binder #3 (008S-D01; SEQ ID NO: 12) or LRP5/6 binder #36 (013S-D05; SEQ ID NO: 13) were cloned in frame to the N-termini of the light chains of respective antibodies as depicted in FIG. 2.

Example 11

Binding Kinetics of Hinge Region-Specific Wnt Surrogate Molecules

Binding kinetics of monospecific Fzd binders to either (CRD) or the extracellular hinge region (hinge) was determined by bio-layer interferometry (BLI) using Octet Red 96 (PALL ForteBio, Fremont, Calif.) instruments at 30° C., 1000 rpm with streptavidin (SA) biosensors. N-terminal biotinylated Fzd1 or Fzd2 CRD and Fzd1 or Fzd 2 hinge proteins were captured on the SA biosensor. Following capture of biotinylated-Fzd1 or Fzd2, the SA biosensor with captured biotinylated-Fzd7 was dipped into wells containing the relevant antibodies at 7 different concentrations in running buffer plus a well with only running buffer as a reference channel. KD was determined by global fitting. As shown in FIGS. 4A-4H these antibody fusion proteins only bound to either Fzd1 or Fzd2 protein with the hinge region, and not to the CRD domains alone.

Example 12

In Vitro Activity of Hinge Region-Specific Wnt Surrogate Molecules

The ability of Wit surrogates comprising antibodies that bind the Fzd1 or Fzd2 hinge regions to activate Whit signaling was assessed in the 293 STF cell line overexpressing either Fzd1 or Fzd2, where the β-Catenin luciferase reporter plasmid Super TOP Flash (STF) was stably integrated. For the Luciferase reporter assays, in each 96 well plate, 1 million cells were seeded, IWP2 (a wnt signaling inhibitor) was added at 3 μM final concentration. 26 hours after seeding, compounds were added to the 96 well plates with triplicates and 10-fold series dilution from 100 nM, and the highest concentration is 500 nM. 18 hours later, cells were lysed with 100 μl lysis buffer. From the above lysed cells, 20 ul samples were transferred to opaque 96-well plates. Toward each well, 10 μl of luciferase substrate was added. The plate was immediately placed in Molecular Device Lum96 plate reader and luciferase luminescence signals were collected. Data were processed with Prism7. These antibodies activated Whit signaling as judged by the induction of luciferase reporter in these cells with either Fzd1 or Fzd 2 overexpression in the present of 20 nM R-spondin 2 (RPSO). These results demonstrate that Fzd hinge binding antibodies when assembled with LRP binders can induce Whit signaling activation.

The recombinant appended IgG proteins were prepared by transfection of respective expression vectors into Expi293F cells (Thermo Fisher Scientific, Waltham, Mass.) according to the manufacturer's instructions. Briefly, four days after the transfection, cell culture medium was collected after spinning down the cell pellet. The media was incubated with Protein A resin (REPLIGEN, Waltham, Mass.) for collecting proteins containing human IgG-Fc portion. Proteins were eluted with 10 mM glycine, pH 3.5 from Protein A resin. Subsequently, the protein elutes were fractionated and further purified by size-exclusion chromatography (SEC). SEC was performed by a fast protein liquid chromatography using a Superdex 200 Increase 10/300 GL (GE Healthcare, Pittsburgh, Pa.) in HBS buffer (10 mM HEPES, 150 mM NaCl, pH7.4). The peak fractions were analyzed by SDS-Polyacrylamide Gel Electrophoresis (SDS-PAGE) to confirm the content. FIGS. 5A and 5B demonstrate that the monospecific Wnt surrogate molecules can activate Wnt signaling.

TABLE 6A

| | | Sequences of Wnt Surrogate Components | |
|---|---|---|---|
| Clone ID | Antigen | VL/VH | Sequence |
| 013S-D05 (#36) | LRP5/6 | VH | QVKLEESGGGLVQAGGSLRLSCAASGRIFSIYDMGWFRQAPGKE EFVSGIRWSGGTSYADSVKGRFTISKDNAKNTIYLQMNNLKAEDT VYYCGSRGYWGQGTLVTVSS (SEQ ID NO: 12) |
| 008S-D01 (#3) | LRP5 | VH | DVQLVESGGGLVQPGGSLRLSCTSSANINSIETLGWYRQAPGK QRELIANMRGGGYMKYAGSLKGRFTMSTESAKNTMYLQMNSL KPEDTAVYYCYVKLRDDDYVYRGQGTQVTVSS (SEQ ID NO: 13) |
| 033S-B03 | Fzd1 | VL | DIVMTQSPLSLPVTPGEPASISCRSSQSLLHSNGYNYLDWYLQ KPGQSPQLLIYLGSIRASGVPDRFSGSGSGTDFTLKISRVEAED VGVYYCMQALQTPLTFGGGTKVEIK (SEQ ID NO: 14) |

TABLE 6A-continued

Sequences of Wnt Surrogate Components

| Clone ID | Antigen | VL/VH | Sequence |
|---|---|---|---|
| 033S-B03 | Fzd1 | VH | QVQLVQSGAEVKKPGSSVKVSCKASGYTFTGQYMHWVRQAP<br>GQGLEWMGGIIPIFGTAHYPQKFQGRVTITADESTSTAYMELSS<br>LRSEDTAVYYCARRSVAAGTPFTDYWGQGTLVTVSS (SEQ ID<br>NO: 15) |
| 033S-D02 | Fzd1 | VL | DIVMTQSPLSLPVTPGEPASISCRSSQSLLHSNGYNYLDWYLQ<br>KPGQSPQLLIYLGSHRASGVPDRFSGSGSGTDFTLKISRVEAE<br>DVGVYYCMQGLQTPITFGGGTKVEIK (SEQ ID NO: 16) |
| 033S-D02 | Fzd1 | VH | QVQLVQSGAEVKKPGSSVKVSCKASGITFTSSAVHWVRQAPG<br>QGLEWLGIINPSGGSTSYAQKFQGRVTITADESTSTAYMELSSL<br>RSEDTAVYYCARRMVYAPYKDVWGKGTMVTVSS (SEQ ID NO:<br>17) |
| 033S-E02 | Fzd1 | VL | DIVMTQSPLSLPVTPGEPASISCRSSQSLLHSNGYNYLDWYLQ<br>KPGQSPQLLIYLGSNRASGVPDRFSGSGSGTDFTLKISRVEAE<br>DVGVYYCMQALQTPLTFGGGTKVEIK (SEQ ID NO: 18) |
| 033S-E02 | Fzd1 | VH | QVQLVQSGAEVKKPGSSVKVSCKASGGTFTSYAISWVRQAPG<br>QGLEWMGMINPSGGRTTYAQKFQGRVTITADESTSTAYMKLS<br>SLRSEDTAVYYCAIRTIFGVVIDYWGQGTLVTVSS (SEQ ID NO:<br>19) |
| 031S-B02 | Fzd2 | VL | EIVMTQSPATLSVSPGERATLSCRASQSVSGSYLAWYQQKPG<br>QAPRLLIYGASTRATGIPARFSGSGSGTEFTLTISSLQSEDFAVY<br>YCQQYGSSPLTFGQGTKVEIK (SEQ ID NO: 20) |
| 031S-B02 | Fzd2 | VH | EVQLLESGGGLVQPGGSLRLSCAASGFTFSSYWMSWVRQAP<br>GKGLEWVSAIGGSGANAYYADSVKGRFT<br>ISRDNSKNTLYLQMNSLRAEDTAVYYCVRDTNWAFDLWGQGT<br>MVTVSS (SEQ ID NO: 21) |

TABLE 6B

Monspecific Wnt Surrogate Constructs

| Construct | SID NO: | Sequence |
|---|---|---|
| 033S-B03-36 LC | 22 | MDMRVPAQLLGLLLLWLRGARC*QVKLEESGGGLVQAGGSLRLSCA*<br>*ASGRIFSIYDMGWFRQAPGKEREFVSGIRWSGGTSYADSVKGRFTI*<br>*SKDNAKNTIYLQMNNLKAEDTAVYYCGSRGYWGQGTLVTVSS*GGS<br>GSDIVMTQSPLSLPVTPGEPASISCRSSQSLLHSNGYNYLDWYLQK<br>PGQSPQLLIYLGSIRASGVPDRFSGSGSGTDFTLKISRVEAEDVGVY<br>YCMQALQTPLTFGGGTKVEIKRTVAAPSVFIFPPSDEQLKSGTASVV<br>CLLNNFYPREAKVQWKVDNALQSGNSQESVTEQDSKDSTYSLSST<br>LTLSKADYEKHKVYACEVTHQGLSSPVTKSFNRGEC* |
| 033S-B03-36 HC | 23 | MDMRVPAQLLGLLLLWLRGARCQVQLVQSGAEVKKPGSSVKVSC<br>KASGYTFTGQYMHWVRQAPGQGLEWMGGIIPIFGTAHYPQKFQG<br>RVTITADESTSTAYMELSSLRSEDTAVYYCARRSVAAGTPFTDYW<br>GQGTLVTVSSASTKGPSVFPLAPSSKSTSGGTAALGCLVKDYFPEP<br>VTVSWNSGALTSGVHTFPAVLQSSGLYSLSSVVTVPSSSLGTQTYI<br>CNVNHKPSNTKVDKKVEPKSCDKTHTCPPCPAPEAAGGPSVFLFP<br>PKPKDTLMISRTPEVTCVVVDVSHEDPEVKFNWYVDGVEVHNAKT<br>KPREEQYNSTYRVVSVLTVLHQDWLNGKEYKCKVSNKALGAPIEKT<br>ISKAKGQPREPQVYTLPPSREEMTKNQVSLTCLVKGFYPSDIAVEW<br>ESNGQPENNYKTTPPVLDSDGSFFLYSKLTVDKSRWQQGNVFSCS<br>VMHEALHNHYTQKSLSLSPGK* |
| 033S-E02-36 LC | 24 | MDMRVPAQLLGLLLLWLRGARC*QVKLEESGGGLVQAGGSLRLSCA*<br>*ASGRIFSIYDMGWFRQAPGKEREFVSGIRWSGGTSYADSVKGRFTI*<br>*SKDNAKNTIYLQMNNLKAEDTAVYYCGSRGYWGQGTLVTVSS*GGS<br>GSDIVMTQSPLSLPVTPGEPASISCRSSQSLLHSNGYNYLDWYLQK<br>PGQSPQLLIYLGSNRASGVPDRFSGSGSGTDFTLKISRVEAEDVGV<br>YYCMQALQTPLTFGGGTKVEIKRTVAAPSVFIFPPSDEQLKSGTASV<br>VCLLNNFYPREAKVQWKVDNALQSGNSQESVTEQDSKDSTYSLSS<br>TLTLSKADYEKHKVYACEVTHQGLSSPVTKSFNRGEC* |

TABLE 6B-continued

| | | Monspecific Wnt Surrogate Constructs |
| --- | --- | --- |
| Construct | SID NO: | Sequence |

| | | |
| --- | --- | --- |
| 033S-E02-36 HC | 25 | MDMRVPAQLLGLLLLWLRGARCQVQLVQSGAEVKKPGSSVKVSC KASGGTFTSYAISWVRQAPGQGLEWMGMINPSGGRTTYAQKFQG RVTITADESTSTAYMKLSSLRSEDTAVYYCAIRTIFGVVIDYWGQGT LVTVSSASTKGPSVFPLAPSSKSTSGGTAALGCLVKDYFPEPVTVS WNSGALTSGVHTFPAVLQSSGLYSLSSVVTVPSSSLGTQTYICNVN HKPSNTKVDKKVEPKSCDKTHTCPPCPAPEAAGGPSVFLFPPKPK DTLMISRTPEVTCVVVDVSHEDPEVKFNWYVDGVEVHNAKTKPRE EQYNSTYRVVSVLTVLHQDWLNGKEYKCKVSNKALGAPIEKTISKA KGQPREPQVYTLPPSREEMTKNQVSLTCLVKGFYPSDIAVEWESN GQPENNYKTTPPVLDSDGSFFLYSKLTVDKSRWQQGNVFSCSVMH EALHNHYTQKSLSLSPGK* |
| 033S-D02-3 LC | 26 | MDMRVPAQLLGLLLLWLRGARC*DVQLVESGGGLVQPGGSLRLSCT SSANINSIETLGWYRQAPGKQRELIANMRGGGYMKYAGSLKGRFT MSTESAKNTMYLQMNSLKPEDTAVYYCYVKLRDDDYVYRGQGTQ VTVSS*GGGSGSDIVMTQSPLSLPVTPGEPASISCRSSQSLLHSNGYN YLDWYLQKPGQSPQLLIYLGSHRASGVPDRFSGSGSGTDFTLKISR VEAEDVGVYYCMQGLQTPITFGGGTKVEIKRTVAAPSVFIFPPSDEQ LKSGTASVVCLLNNFYPREAKVQWKVDNALQSGNSQESVTEQDSK DSTYSLSSTLTLSKADYEKHKVYACEVTHQGLSSPVTKSFNRGEC* |
| 033S-D02-3 HC | 27 | MDMRVPAQLLGLLLLWLRGARCQVQLVQSGAEVKKPGSSVKVSC KASGITFTSSAVHWVRQAPGQGLEWLGIINPSGGSTSYAQKFQGR VTITADESTSTAYMELSSLRSEDTAVYYCARRMVYAPYKDVWGKG TMVTVSSASTKGPSVFPLAPSSKSTSGGTAALGCLVKDYFPEPVTV SWNSGALTSGVHTFPAVLQSSGLYSLSSVVTVPSSSLGTQTYICNV NHKPSNTKVDKKVEPKSCDKTHTCPPCPAPEAAGGPSVFLFPPKP KDTLMISRTPEVTCVVVDVSHEDPEVKFNWYVDGVEVHNAKTKPR EEQYNSTYRVVSVLTVLHQDWLNGKEYKCKVSNKALGAPIEKTISK AKGQPREPQVYTLPPSREEMTKNQVSLTCLVKGFYPSDIAVEWES NGQPENNYKTTPPVLDSDGSFFLYSKLTVDKSRWQQGNVFSCSVM HEALHNHYTQKSLSLSPGK* |
| 031S-B02-36 LC | 28 | MDMRVPAQLLGLLLLWLRGARC*QVKLEESGGGLVQAGGSLRLSCA ASGRIFSIYDMGWFRQAPGKEREFVSGIRWSGGTSYADSVKGRFTI SKDNAKNTIYLQMNNLKAEDTAVYYCGSRGYWGQGTLVTVSS*GGGSGSEIVMTQSPATLSVSPGERATLSCRASQSVSGSYLAWYQQK PGQAPRLLIYGASTRATGIPARFSGSGSGTEFTLTISSLQSEDFAVY YCQQYGSSPLTFGQGTKVEIKRTVAAPSVFIFPPSDEQLKSGTASV VCLLNNFYPREAKVQWKVDNALQSGNSQESVTEQDSKDSTYSLSS TLTLSKADYEKHKVYACEVTHQGLSSPVTKSFNRGEC* |
| 031S-B02-36 HC | 29 | MDMRVPAQLLGLLLLWLRGARCEVQLLESGGGLVQPGGSLRLSC AASGFTFSSYWMSWVRQAPGKGLEWVSAIGGSGANAYYADSVK GRFTISRDNSKNTLYLQMNSLRAEDTAVYYCVRDTNWAFDLWGQ GTMVTVSSASTKGPSVFPLAPSSKSTSGGTAALGCLVKDYFPEPVT VSWNSGALTSGVHTFPAVLQSSGLYSLSSVVTVPSSSLGTQTYICN VNHKPSNTKVDKKVEPKSCDKTHTCPPCPAPEAAGGPSVFLFPPK PKDTLMISRTPEVTCVVVDVSHEDPEVKFNWYVDGVEVHNAKTKP REEQYNSTYRVVSVLTVLHQDWLNGKEYKCKVSNKALGAPIEKTIS KAKGQPREPQVYTLPPSREEMTKNQVSLTCLVKGFYPSDIAVEWE SNGQPENNYKTTPPVLDSDGSFFLYSKLTVDKSRWQQGNVFSCSV MHEALHNHYTQKSLSLSPGK* |

Lrp VHH or sdAb = italics
anti-Fzd light chain = underline
anti-Fzd heavy chain = bold The various embodiments described above can be combined to provide further embodiments. All of the U.S. patents, U.S. patent application publications, U.S. patent application, foreign patents, foreign patent application and non-patent publications referred to in this specification and/or listed in the Application Data Sheet are incorporated herein by reference, in their entirety. Aspects of the embodiments can be modified, if necessary to employ concepts of the various patents, application and publications to provide yet further embodiments.

These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

SEQUENCE LISTING (4203 sequences)

SEQ ID NO: 1 - protein, 50 aa, Homo sapiens
CVGQNTSDKGTPTPSLLPEFWTSNPQHGGGGHRGGFPGGAGASERGKFSC

SEQ ID NO: 2 - protein, 52 aa, Homo sapiens
CVGQNHSEDGAPALLTTAPPPGLQPGAGGTPGGPGGGGAPPRYATLEHPFHC

SEQ ID NO: 3 - protein, 33 aa, Homo sapiens
CDEPYPRLVDLNLAGEPTEGAPVAVQRDYGFWC

SEQ ID NO: 4 - protein, 24 aa, Homo sapiens
CMEGPGDEEVPLPHKTPIQPGEEC

SEQ ID NO: 5 - protein, 36 aa, Homo sapiens
CMDYNRSEATTAPPRPFPAKPTLPGPPGAPASGGEC

SEQ ID NO: 6 - protein, 33 aa, Homo sapiens
CDETVPVTFDPHTEFLGPQKKTEQVQRDIGFWC

SEQ ID NO: 7 - protein, 49 aa, Homo sapiens
CVGQNTSDGSGGAGGSPTAYPTAPYLPDPPFTAMSPSDGRGRLSFPFSC

SEQ ID NO: 8 - protein, 81 aa, Homo sapiens
CMDYNRTDLTTAAPSPPRRLPPPPPGEQPPSGSGHGRPPGARPPHRGGGRGGGGGDAAAPPARGGGGGGKARPPGGGAAPC

SEQ ID NO: 9 - protein, 45 aa, Homo sapiens
CMEAPENATAGPAEPHKGLGMLPVAPRPARPPGDLGPGAGGSGTC

SEQ ID NO: 10 - protein, 46 aa, Homo sapiens
CMEAPNNGSDEPTRGSGLFPPLFRPQRPHSAQEHPLKDGGPGRGGC

SEQ ID NO: 11 - protein, 134 aa, Artificial Sequence
  Human Fzd8 with histine tag
ASAKELACQEITVPLCKGIGYNYTYMPNQFNHDTQDEAGLEVHQFWPLVEIQCSPDLKFFLCSMYTPICLEDYKKPLPPCRSVCERAKAGCAPLMRQYGFAWPDRMRCDRLPEQGNPDTLCMDYNRHHHHHHHH

SEQ ID NO: 12 - protein, 111 aa, Artificial Sequence
  Anti LRP5/6 VH Chain from clone 013S-D05
QVKLEESGGGLVQAGGSLRLSCAASGRIFSIYDMGWFRQAPGKEREFVSGIRWSGGTSYADSVKGRFTISKDNAKNTIYLQMNNLKAEDTAVYYCGSRGYWGQGTLVTVSS

SEQ ID NO: 13 - protein, 117 aa, Artificial Sequence
  Anti LRP5 VH Chain from clone 013S-D05
DVQLVESGGGLVQPGGSLRLSCTSSANINSIETLGWYRQAPGKQRELIANMRGGGYMKYAGSLKGRFTMSTESAKNTMYLQMNSLKPEDTAVYYCYVKLRDDDYVYRGQGTQVTVSS

SEQ ID NO: 14 - protein, 112 aa, Artificial Sequence
  Anti-Fzd1 VL chain from clone 033S-B03
DIVMTQSPLSLPVTPGEPASISCRSSQSLLHSNGYNYLDWYLQKPGQSPQLLIYLGSIRASGVPDRFSGSGSGTDFTLKISRVEAEDVGVYYCMQALQTPLTFGGGTKVEIK

SEQ ID NO: 15 - protein, 121 aa, Artificial Sequence
  Anti-Fzd1 VH chain from clone 033S-B03
QVQLVQSGAEVKKPGSSVKVSCKASGYTFTGQYMHWVRQAPGQGLEWMGGIIPIFGTAHYPQKFQGRVTITADESTSTAYMELSSLRSEDTAVYYCARRSVAAGTPFTDYWGQGTLVTVSS

SEQ ID NO: 16 - protein, 112 aa, Artificial Sequence
  Anti-Fzd1 VL chain from clone 033S-D02
DIVMTQSPLSLPVTPGEPASISCRSSQSLLHSNGYNYLDWYLQKPGQSPQLLIYLGSHRASGVPDRFSGSGSGTDFTLKISRVEAEDVGVYYCMQGLQTPITFGGGTKVEIK

SEQ ID NO: 17 - protein, 119 aa, Artificial Sequence
  Anti-Fzd1 VH chain from clone 033S-D02
QVQLVQSGAEVKKPGSSVKVSCKASGITFTSSAVHWVRQAPGQGLEWLGIINPSGGSTSYAQKFQGRVTITADESTSTAYMELSSLRSEDTAVYYCARRMVYAPYKDVWGKGTMVTVSS

SEQ ID NO: 18 - protein, 112 aa, Artificial Sequence
  Anti-Fzd1 VL chain from clone 033S-E02
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIK

SEQ ID NO: 19 - protein, 119 aa, Artificial Sequence
  Anti-Fzd1 VH chain from clone 033S-E02
QVQLVQSGAEVKKPGSSVKVSCKASGGTFTSYAISWVRQAPGQGLEWMGMINPSGGRTTYAQKFQGRVTITADESTSTAYMKLSSLRSEDTAVYYCAIRTIFGVVIDYWGQGTLVTVSS

SEQ ID NO: 20 - protein, 108 aa, Artificial Sequence
  Anti-Fzd1 VL chain from clone 031S-B02
EIVMTQSPATLSVSPGERATLSCRASQSVSGSYLAWYQQKPGQAPRLLIYGASTRATGIPARFSGSGSGTEFTLTISSLQSEDFAVYYCQQYGSSPLTFGQGTKVEIK

SEQ ID NO: 21 - protein, 117 aa, Artificial Sequence
  Anti-Fzd1 VH chain from clone 031S-B02
EVQLLESGGGLVQPGGSLRLSCAASGFTFSSYWMSWVRQAPGKGLEWVSAIGGSGANAYYADSVKGRFTISRDNSKNTLYLQMNSLRAEDTAVYYCVRDTNWAFDLWGQGTMVTVSS

SEQ ID NO: 22 - protein, 357 aa, Artificial Sequene
  Made in Lab - wnt surrogate construct
MDMRVPAQLLGLLLLWLRGARCQVKLEESGGGLVQAGGSLRLSCAASGRIFSIYDMGWFRQAPGKEREFVSGIRWSGGTSYADSVKGRFTISKDNAKNTIYLQMNNLKAEDTAVYYCGSRGYWGQGTLVTVSSGGSGSDIVMTQSPLSLPVTPGEPASISCRSSQSLLHSNGYNYLDWYLQKPGQSPQLLIYLGSIRASGVPDRFSGSGSGTDFTLKISRVEAEDVGVYYCMQALQTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 23 - protein, 473 aa, Artificial Sequence
  Made in Lab - wnt surrogate construct
MDMRVPAQLLGLLLLWLRGARCQVQLVQSGAEVKKPGSSVKVSCKASGYTFTGQYMHWVRQAPGQGLEWMGGIIPIFGTAHYPQKFQGRVTITADESTSTAYMELSSLRSEDTAVYYCARRSVAAGTPFTDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24 - protein, 357 aa, Artificial Sequene
  Made in Lab - wnt surrogate construct
MDMRVPAQLLGLLLLWLRGARCQVKLEESGGGLVQAGGSLRLSCAASGRIFSIYDMGWFRQAPGKEREFVSGIRWSGGTSYADSVKGRFTISKDNAKNTIYLQMNNLKAEDTAVYYCGSRGYWGQGTLVTVSSGGSGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25 - protein, 471 aa, Artificial Sequence
  Made in Lab - wnt surrogate construct
MDMRVPAQLLGLLLLWLRGARCQVQLVQSGAEVKKPGSSVKVSCKASGGTFTSYAISWVRQAPGQGLEWMGMINPSGGRTTYAQKFQGRVTITADESTSTAYMKLSSLRSEDTAVYYCAIRTIFGVVIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 363 aa, Artificial Sequene
  Made in Lab - wnt surrogate construct
MDMRVPAQLLGLLLLWLRGARCDVQLVESGGGLVQPGGSLRLSCTSSANINSIETLGWYRQAPGKQRELIANMRGGGYMKYAGSLKGRFTMSTESAKNTMYLQMNSLKPEDTAVYYCYVKLRDDDYVYRGQGTQVTVSSGGSGSDIVMTQSPLSLPVTPGEPASISCRSSQSLLHSNGYNYLDWYLQKPGQSPQLLIYLGSHRASGVPDRFSGSGSGTDFTLKISRVEAEDVGVYYCMQGLQTPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27 - protein, 471 aa, Artificial Sequence
  Made in Lab - wnt surrogate construct
MDMRVPAQLLGLLLLWLRGARCQVQLVQSGAEVKKPGSSVKVSCKASGITFTSSAVHWVRQAPGQGLEWLGIINPSGGSTSYAQKFQGRVTITADESTSTAYMELSSLRSEDTAVYYCARRMVYAPYKDVWGKGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 353 aa, Artificial Sequene
  Made in Lab - wnt surrogate construct
MDMRVPAQLLGLLLLWLRGARCQVKLEESGGGLVQAGGSLRLSCAASGRIFSIYDMGWFRQAPGKEREFVSGIRWSGGTSYADSVKGRFTISKDNAKNTIYLQMNNLKAEDTAVYYCGSRGYWGQGTLVTVSSGGSGSEIVMTQSPATLSVSPGERATLSCRASQSVSGSYLAWYQQKPGQAPRLLIYGASTRATGIPARFSGSGSGTEFTLTISSLQSEDFAVYYCQQYGSSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29 - protein, 469 aa, Artificial Sequence
  Made in Lab - wnt surrogate construct
MDMRVPAQLLGLLLLWLRGARCEVQLLESGGGLVQPGGSLRLSCAASGFTFSSYWMSWVRQAPGKGLEWVSAIGGSGANAYYADSVKGRFTISRDNSKNTLYLQMNSLRAEDTAVYYCVRDTNWAFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 242 aa, Artificial Sequence
  VH chain of 027S-E5 Fab clone with histine tag
QVQLEQSGAEVKKPGASVKVSCKASGGTFSSYAISWVRQAPGQGLEWMGMINPSGGSTTYAQKFQGRVTMTRDTSTSTVYMELSSLRSEDTAVYYCARQAGLHCSSTSCYLGNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSGSGHHHHHH

SEQ ID NO: 31 - protein, 214 aa, Artificial Sequence
  VL chain of 027S-E5 Fab clone with histine tag
DIQMTQSPSSLSASVGDRVTITCRASQGITKSLAWYQQKPGKAPKLLIYAASNLATGVPSRFSGSGSGTDFTLTISSLQPEDFATYYCQQYNTFPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32 - protein, 90 aa, Homo sapiens
KMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 33 - protein, 88 aa, Homo sapiens
KMSHIKGHEGDPCLRSSDCIEGFCCARHFWTKICKPVLHQGEVCTKQRKKGSHGLEIFQRCDCAKGLSCKVWKDATYSSKARLHVCQK

SEQ ID NO: 34 - protein, 9 aa, Artificial Sequence
  Made in Lab - CRDH1 from anti-Fzd VH chain
YTFTSYYMH

SEQ ID NO: 35 - protein, 9 aa, Artificial Sequence
  Made in Lab - CRDH1 from anti-Fzd VH chain
DTLSSYGIS

SEQ ID NO: 36 - protein, 9 aa, Artificial Sequence
  Made in Lab - CRDH1 from anti-Fzd VH chain
GTFSSSAIS

SEQ ID NO: 37 - protein, 9 aa, Artificial Sequence
  Made in Lab - CRDH1 from anti-Fzd VH chain
GTFSRYGIS

SEQ ID NO: 38 - protein, 9 aa, Artificial Sequence
  Made in Lab - CRDH1 from anti-Fzd VH chain
GTFSTYAFN

SEQ ID NO: 39 - protein, 9 aa, Artificial Sequence
  Made in Lab - CRDH1 from anti-Fzd VH chain
GTFTYDYMH

SEQ ID NO: 40 - protein, 9 aa, Artificial Sequence
  Made in Lab - CRDH1 from anti-Fzd VH chain
YSFTSYYMY

SEQ ID NO: 41 - protein, 9 aa, Artificial Sequence
  Made in Lab - CRDH1 from anti-Fzd VH chain
GSFTNYAIS

SEQ ID NO: 42 - protein, 9 aa, Artificial Sequence
  Made in Lab - CRDH1 from anti-Fzd VH chain
YTFTRYGMN

SEQ ID NO: 43 - protein, 9 aa, Artificial Sequence
  Made in Lab - CRDH1 from anti-Fzd VH chain
DTFDTYAIS

SEQ ID NO: 44 - protein, 9 aa, Artificial Sequence
  Made in Lab - CRDH1 from anti-Fzd VH chain
GTFSNYAIS

SEQ ID NO: 45 - protein, 9 aa, Artificial Sequence
  Made in Lab - CRDH1 from anti-Fzd VH chain
ITFTSSAVH

SEQ ID NO: 46 - protein, 9 aa, Artificial Sequence
  Made in Lab - CRDH1 from anti-Fzd VH chain
GTFTSYAIS

SEQ ID NO: 47 - protein, 9 aa, Artificial Sequence
  Made in Lab - CRDH1 from anti-Fzd VH chain
GTFSNSIIN

SEQ ID NO: 48 - protein, 9 aa, Artificial Sequence
  Made in Lab - CRDH1 from anti-Fzd VH chain
GTFSSYAIS

SEQ ID NO: 49 - protein, 9 aa, Artificial Sequence
  Made in Lab - CRDH1 from anti-Fzd VH chain
YTFTSYYMH

SEQ ID NO: 50 - protein, 9 aa, Artificial Sequence
  Made in Lab - CRDH1 from anti-Fzd VH chain
GTFSSYAIS

SEQ ID NO: 51 - protein, 9 aa, Artificial Sequence
  Made in Lab - CRDH1 from anti-Fzd VH chain
YTFTGQYMH

SEQ ID NO: 52 - protein, 9 aa, Artificial Sequence
  Made in Lab - CRDH1 from anti-Fzd VH chain
YDFTDHFVH

SEQ ID NO: 53 - protein, 9 aa, Artificial Sequence
  Made in Lab - CRDH1 from anti-Fzd VH chain
FTFTSSAVQ

SEQ ID NO: 54 - protein, 9 aa, Artificial Sequence
  Made in Lab - CRDH1 from anti-Fzd VH chain
FSFENYWMS

SEQ ID NO: 55 - protein, 9 aa, Artificial Sequence
  Made in Lab - CRDH1 from anti-Fzd VH chain
GTFSNYAIS

SEQ ID NO: 56 - protein, 9 aa, Artificial Sequence
  Made in Lab - CRDH1 from anti-Fzd VH chain
YRFTDYYFY

SEQ ID NO: 57 - protein, 9 aa, Artificial Sequence
  Made in Lab - CRDH1 from anti-Fzd VH chain
  misc_feature (7)..(7): Xaa can be any naturally occurring amino acid
YIFTNYXIQ

SEQ ID NO: 58 - protein, 9 aa, Artificial Sequence
  Made in Lab - CRDH1 from anti-Fzd VH chain
DTFTGYYIH

SEQ ID NO: 59 - protein, 9 aa, Artificial Sequence
  Made in Lab - CRDH1 from anti-Fzd VH chain
  misc_feature (6)..(6): Xaa can be any naturally occurring amino acid
HTFSDXYMH

SEQ ID NO: 60 - protein, 9 aa, Artificial Sequence
  Made in Lab - CRDH1 from anti-Fzd VH chain
HTFTGYYIH

SEQ ID NO: 61 - protein, 9 aa, Artificial Sequence
  Made in Lab - CRDH1 from anti-Fzd VH chain
YPFIGQYLH

SEQ ID NO: 62 - protein, 9 aa, Artificial Sequence
  Made in Lab - CRDH1 from anti-Fzd VH chain
GTFTSYYMH

SEQ ID NO: 63 - protein, 9 aa, Artificial Sequence
  Made in Lab - CRDH1 from anti-Fzd VH chain
YTFTGYYVH

SEQ ID NO: 64 - protein, 9 aa, Artificial Sequence
  Made in Lab - CRDH1 from anti-Fzd VH chain
YTFTSYYMH

SEQ ID NO: 65 - protein, 9 aa, Artificial Sequence
  Made in Lab - CRDH1 from anti-Fzd VH chain
YTFRRYGIS

SEQ ID NO: 66 - protein, 9 aa, Artificial Sequence
  Made in Lab - CRDH1 from anti-Fzd VH chain
NNFGSYAIT

SEQ ID NO: 67 - protein, 9 aa, Artificial Sequence
  Made in Lab - CRDH1 from anti-Fzd VH chain
YTFTYYHMH

SEQ ID NO: 68 - protein, 9 aa, Artificial Sequence
  Made in Lab - CRDH1 from anti-Fzd VH chain
YTFTNYAMH

SEQ ID NO: 69 - protein, 9 aa, Artificial Sequence
  Made in Lab - CRDH1 from anti-Fzd VH chain
DTFTSYYMH

SEQ ID NO: 70 - protein, 9 aa, Artificial Sequence
  Made in Lab - CRDH1 from anti-Fzd VH chain
YTFTNHWMH

SEQ ID NO: 71 - protein, 9 aa, Artificial Sequence
  Made in Lab - CRDH1 from anti-Fzd VH chain
YTFTNYYIH

SEQ ID NO: 72 - protein, 9 aa, Artificial Sequence
  Made in Lab - CRDH1 from anti-Fzd VH chain
YTFTSYDIN

SEQ ID NO: 73 - protein, 9 aa, Artificial Sequence
  Made in Lab - CRDH1 from anti-Fzd VH chain
  misc_feature (6)..(6): Xaa can be any naturally occurring amino acid
YTFPAXYMH

SEQ ID NO: 74 - protein, 9 aa, Artificial Sequence
  Made in Lab - CRDH1 from anti-Fzd VH chain
YTFTGYYMH

SEQ ID NO: 75 - protein, 9 aa, Artificial Sequence
  Made in Lab - CRDH1 from anti-Fzd VH chain
FTFGDHALS

SEQ ID NO: 76 - protein, 9 aa, Artificial Sequence
  Made in Lab - CRDH1 from anti-Fzd VH chain
FTFSPYGMH

SEQ ID NO: 77 - protein, 9 aa, Artificial Sequence
  Made in Lab - CRDH1 from anti-Fzd VH chain
  misc_feature (1)..(1): Xaa can be any naturally occurring amino acid
XTFTDYAMD

SEQ ID NO: 78 - protein, 9 aa, Artificial Sequence
  Made in Lab - CRDH1 from anti-Fzd VH chain
DTFSRSVFS

SEQ ID NO: 79 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 80 - protein, 9 aa, Artificial Sequence
  Made in Lab - CRDH1 from anti-Fzd VH chain
YTFTSYYMH

SEQ ID NO: 81 - protein, 9 aa, Artificial Sequence
  Made in Lab - CRDH1 from anti-Fzd VH chain
YTFSSYYIH

SEQ ID NO: 82 - protein, 9 aa, Artificial Sequence
  Made in Lab - CRDH1 from anti-Fzd VH chain
YTFTGYYMH

SEQ ID NO: 83 - protein, 9 aa, Artificial Sequence
  Made in Lab - CRDH1 from anti-Fzd VH chain
YTFTSYYMH

SEQ ID NO: 84 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 85 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 86 - protein, 9 aa, Artificial Sequence
  Made in Lab - CRDH1 from anti-Fzd VH chain
YTFTGYYMH

SEQ ID NO: 87 - protein, 9 aa, Artificial Sequence
  Made in Lab - CRDH1 from anti-Fzd VH chain
YTFTSYGTS

SEQ ID NO: 88 - protein, 9 aa, Artificial Sequence
  Made in Lab - CRDH1 from anti-Fzd VH chain
YTFTSYYMH

SEQ ID NO: 89 - protein, 9 aa, Artificial Sequence
  Made in Lab - CRDH1 from anti-Fzd VH chain
YTFTSYHIH

SEQ ID NO: 90 - protein, 9 aa, Artificial Sequence
  Made in Lab - CRDH1 from anti-Fzd VH chain
GTFSSYAIS

SEQ ID NO: 91 - protein, 9 aa, Artificial Sequence
  Made in Lab - CRDH1 from anti-Fzd VH chain
YTFTGYYMH

SEQ ID NO: 92 - protein, 9 aa, Artificial Sequence
  Made in Lab - CRDH1 from anti-Fzd VH chain
YTFTSYYMH

SEQ ID NO: 93 - protein, 9 aa, Artificial Sequence
  Made in Lab - CRDH1 from anti-Fzd VH chain
RTFSIKPMG

SEQ ID NO: 94 - protein, 9 aa, Artificial Sequence
  Made in Lab - CRDH1 from anti-Fzd VH chain
YTFTGYYMH

SEQ ID NO: 95 - protein, 9 aa, Artificial Sequence
  Made in Lab - CRDH1 from anti-Fzd VH chain
FTFSDHYMS

SEQ ID NO: 96 - protein, 9 aa, Artificial Sequence
  Made in Lab - CRDH1 from anti-Fzd VH chain
YTFTTYYLH

SEQ ID NO: 97 - protein, 9 aa, Artificial Sequence
  Made in Lab - CRDH1 from anti-Fzd VH chain
YTFTGYPIH

SEQ ID NO: 98 - protein, 9 aa, Artificial Sequence
  Made in Lab - CRDH1 from anti-Fzd VH chain
YTFTSYYMH

SEQ ID NO: 99 - protein, 9 aa, Artificial Sequence
  Made in Lab - CRDH1 from anti-Fzd VH chain
YTFTGYYMH

SEQ ID NO: 100 - protein, 9 aa, Artificial Sequence
  Made in Lab - CRDH1 from anti-Fzd VH chain
YTFTGYYVH

SEQ ID NO: 101 - protein, 9 aa, Artificial Sequence
  Made in Lab - CRDH1 from anti-Fzd VH chain
YTZTSYYMH

SEQ ID NO: 102 - protein, 9 aa, Artificial Sequence
  Made in Lab - CRDH1 from anti-Fzd VH chain
YTFTSYYMH

SEQ ID NO: 103 - protein, 9 aa, Artificial Sequence
  Made in Lab - CRDH1 from anti-Fzd VH chain
GTFSSYAIS

SEQ ID NO: 104 - protein, 9 aa, Artificial Sequence
  Made in Lab - CRDH1 from anti-Fzd VH chain
YTFTGYYMH

SEQ ID NO: 105 - protein, 9 aa, Artificial Sequence
  Made in Lab - CRDH1 from anti-Fzd VH chain
YTFTSYYMH

SEQ ID NO: 106 - protein, 9 aa, Artificial Sequence
  Made in Lab - CRDH1 from anti-Fzd VH chain
GTFSSYAIS

SEQ ID NO: 107 - protein, 9 aa, Artificial Sequence
  Made in Lab - CRDH1 from anti-Fzd VH chain
YTFTHYYMH

SEQ ID NO: 108 - protein, 9 aa, Artificial Sequence
  Made in Lab - CRDH1 from anti-Fzd VH chain
YTLTHYYMH

SEQ ID NO: 109 - protein, 9 aa, Artificial Sequence
  Made in Lab - CRDH1 from anti-Fzd VH chain
YTFTGYYMH

SEQ ID NO: 110 - protein, 9 aa, Artificial Sequence
  Made in Lab - CRDH1 from anti-Fzd VH chain
YTFTGTYMH

SEQ ID NO: 111 - protein, 9 aa, Artificial Sequence
  Made in Lab - CRDH1 from anti-Fzd VH chain
YTFTSYYMH

SEQ ID NO: 112 - protein, 9 aa, Artificial Sequence
  Made in Lab - CRDH1 from anti-Fzd VH chain
FTFSSSWMH

SEQ ID NO: 113 - protein, 9 aa, Artificial Sequence
  Made in Lab - CRDH1 from anti-Fzd VH chain
YSFNGYYMH

SEQ ID NO: 114 - protein, 9 aa, Artificial Sequence
  Made in Lab - CRDH1 from anti-Fzd VH chain
FTFSSYGMH

SEQ ID NO: 115 - protein, 9 aa, Artificial Sequence
  Made in Lab - CRDH1 from anti-Fzd VH chain
YTFSSYYIH

SEQ ID NO: 116 - protein, 9 aa, Artificial Sequence
  Made in Lab - CRDH1 from anti-Fzd VH chain
  misc_feature (7)..(7): Xaa can be any naturally occurring amino acid
FZZSSYXMS

SEQ ID NO: 117 - protein, 9 aa, Artificial Sequence
  Made in Lab - CRDH1 from anti-Fzd VH chain
YTFTKDYMH

SEQ ID NO: 118 - protein, 9 aa, Artificial Sequence
  Made in Lab - CRDH1 from anti-Fzd VH chain
  misc_feature (7)..(7): Xaa can be any naturally occurring amino acid
FAFSSYXMN

SEQ ID NO: 119 - protein, 9 aa, Artificial Sequence
  Made in Lab - CRDH1 from anti-Fzd VH chain
YTFTGYYMH

SEQ ID NO: 120 - protein, 9 aa, Artificial Sequence
  Made in Lab - CRDH1 from anti-Fzd VH chain
YTFTTYYMH

SEQ ID NO: 121 - protein, 9 aa, Artificial Sequence
  Made in Lab - CRDH1 from anti-Fzd VH chain
YTFTSYYMH

SEQ ID NO: 122 - protein, 9 aa, Artificial Sequence
  Made in Lab - CRDH1 from anti-Fzd VH chain
GTFTRYTMH

SEQ ID NO: 123 - protein, 9 aa, Artificial Sequence
  Made in Lab - CRDH1 from anti-Fzd VH chain
DTFSTYAIS

SEQ ID NO: 124 - protein, 9 aa, Artificial Sequence
  Made in Lab - CRDH1 from anti-Fzd VH chain
FTFSNAWMS

SEQ ID NO: 125 - protein, 9 aa, Artificial Sequence
  Made in Lab - CRDH1 from anti-Fzd VH chain
GTFSSYAIS

SEQ ID NO: 126 - protein, 9 aa, Artificial Sequence
  Made in Lab - CRDH1 from anti-Fzd VH chain
FRFSDYSMN

SEQ ID NO: 127 - protein, 9 aa, Artificial Sequence
  Made in Lab - CRDH1 from anti-Fzd VH chain
GTFSSYAIS

SEQ ID NO: 128 - protein, 9 aa, Artificial Sequence
  Made in Lab - CRDH1 from anti-Fzd VH chain
YTFTGHYMH

SEQ ID NO: 129 - protein, 9 aa, Artificial Sequence
  Made in Lab - CRDH1 from anti-Fzd VH chain
FTFKEHGMH

SEQ ID NO: 130 - protein, 9 aa, Artificial Sequence
  Made in Lab - CRDH1 from anti-Fzd VH chain
GTFSSYAIS

SEQ ID NO: 131 - protein, 9 aa, Artificial Sequence
  Made in Lab - CRDH1 from anti-Fzd VH chain
YAFTSYYMH

SEQ ID NO: 132 - protein, 9 aa, Artificial Sequence
  Made in Lab - CRDH1 from anti-Fzd VH chain
YTFTGYYMH

SEQ ID NO: 133 - protein, 9 aa, Artificial Sequence
  Made in Lab - CRDH1 from anti-Fzd VH chain
GTFNSYAIS

SEQ ID NO: 134 - protein, 9 aa, Artificial Sequence
  Made in Lab - CRDH1 from anti-Fzd VH chain
GTFSSYAIN

SEQ ID NO: 135 - protein, 9 aa, Artificial Sequence
  Made in Lab - CRDH1 from anti-Fzd VH chain
FTFSNHYTS

SEQ ID NO: 136 - protein, 9 aa, Artificial Sequence
  Made in Lab - CRDH1 from anti-Fzd VH chain
YTFTSYHMH

SEQ ID NO: 137 - protein, 9 aa, Artificial Sequence
  Made in Lab - CRDH1 from anti-Fzd VH chain
GTFSNYGVS

SEQ ID NO: 138 - protein, 9 aa, Artificial Sequence
  Made in Lab - CRDH1 from anti-Fzd VH chain
YPFTNNYIH

SEQ ID NO: 139 - protein, 9 aa, Artificial Sequence
  Made in Lab - CRDH1 from anti-Fzd VH chain
DTFTKYAIH

SEQ ID NO: 140 - protein, 9 aa, Artificial Sequence
  Made in Lab - CRDH1 from anti-Fzd VH chain
GTFSSYAIS

SEQ ID NO: 141 - protein, 9 aa, Artificial Sequence
  Made in Lab - CRDH1 from anti-Fzd VH chain
YTFTGHYLH

SEQ ID NO: 142 - protein, 9 aa, Artificial Sequence
  Made in Lab - CRDH1 from anti-Fzd VH chain
GTFTAYYLH

SEQ ID NO: 143 - protein, 9 aa, Artificial Sequence
  Made in Lab - CRDH1 from anti-Fzd VH chain
YTFTGYFIH

SEQ ID NO: 144 - protein, 9 aa, Artificial Sequence
  Made in Lab - CRDH1 from anti-Fzd VH chain
GTFSSYAIS

SEQ ID NO: 145 - protein, 9 aa, Artificial Sequence
  Made in Lab - CRDH1 from anti-Fzd VH chain
GTFDNYAIS

SEQ ID NO: 146 - protein, 9 aa, Artificial Sequence
  Made in Lab - CRDH1 from anti-Fzd VH chain
GTFSNYAIN

SEQ ID NO: 147 - protein, 9 aa, Artificial Sequence
  Made in Lab - CRDH1 from anti-Fzd VH chain
GTFSNYAIS

SEQ ID NO: 148 - protein, 9 aa, Artificial Sequence
  Made in Lab - CRDH1 from anti-Fzd VH chain
FTFSNSDMN

SEQ ID NO: 149 - protein, 9 aa, Artificial Sequence
  Made in Lab - CRDH1 from anti-Fzd VH chain
FTFSPYAMH

SEQ ID NO: 150 - protein, 9 aa, Artificial Sequence
  Made in Lab - CRDH1 from anti-Fzd VH chain
FTFSSYAMH

SEQ ID NO: 151 - protein, 9 aa, Artificial Sequence
  Made in Lab - CRDH1 from anti-Fzd VH chain
GTFSSYAIS

SEQ ID NO: 152 - protein, 9 aa, Artificial Sequence
  Made in Lab - CRDH1 from anti-Fzd VH chain
GTFSRNGIS

SEQ ID NO: 153 - protein, 9 aa, Artificial Sequence
  Made in Lab - CRDH1 from anti-Fzd VH chain
GTFRSHVIS

SEQ ID NO: 154 - protein, 9 aa, Artificial Sequence
  Made in Lab - CRDH1 from anti-Fzd VH chain
YTFNSYYVH

SEQ ID NO: 155 - protein, 9 aa, Artificial Sequence
  Made in Lab - CRDH1 from anti-Fzd VH chain
DTFSHYAFS

SEQ ID NO: 156 - protein, 9 aa, Artificial Sequence
  Made in Lab - CRDH1 from anti-Fzd VH chain
DTFDTYAIS

SEQ ID NO: 157 - protein, 9 aa, Artificial Sequence
  Made in Lab - CRDH1 from anti-Fzd VH chain
YTFTSYYMH

SEQ ID NO: 158 - protein, 9 aa, Artificial Sequence
  Made in Lab - CRDH1 from anti-Fzd VH chain
FTFSSYGMH

SEQ ID NO: 159 - protein, 9 aa, Artificial Sequence
  Made in Lab - CRDH1 from anti-Fzd VH chain
YSFTRYHMH

SEQ ID NO: 160 - protein, 9 aa, Artificial Sequence
  Made in Lab - CRDH1 from anti-Fzd VH chain
GRFSRYAIS

SEQ ID NO: 161 - protein, 9 aa, Artificial Sequence
  Made in Lab - CRDH1 from anti-Fzd VH chain
GTFSSYPIS

SEQ ID NO: 162 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 163 - protein, 9 aa, Artificial Sequence
  Made in Lab - CRDH1 from anti-Fzd VH chain
GTFSSYPLS

SEQ ID NO: 164 - protein, 9 aa, Artificial Sequence
  Made in Lab - CRDH1 from anti-Fzd VH chain
YTFTSYYMH

SEQ ID NO: 165 - protein, 9 aa, Artificial Sequence
  Made in Lab - CRDH1 from anti-Fzd VH chain
GTFSTHAIS

SEQ ID NO: 166 - protein, 9 aa, Artificial Sequence
  Made in Lab - CRDH1 from anti-Fzd VH chain
YTFTTYYIH

SEQ ID NO: 167 - protein, 9 aa, Artificial Sequence
  Made in Lab - CRDH1 from anti-Fzd VH chain
NTFTGYYIH

SEQ ID NO: 168 - protein, 9 aa, Artificial Sequence
  Made in Lab - CRDH1 from anti-Fzd VH chain
GTFSSYAIS

SEQ ID NO: 169 - protein, 9 aa, Artificial Sequence
  Made in Lab - CRDH1 from anti-Fzd VH chain
FTFSSYAMH

SEQ ID NO: 170 - protein, 9 aa, Artificial Sequence
  Made in Lab - CRDH1 from anti-Fzd VH chain
FIFSNYAMH

SEQ ID NO: 171 - protein, 9 aa, Artificial Sequence
  Made in Lab - CRDH1 from anti-Fzd VH chain
FTFSSAWMS

SEQ ID NO: 172 - protein, 9 aa, Artificial Sequence
  Made in Lab - CRDH1 from anti-Fzd VH chain
  misc_feature (5)..(5): Xaa can be any naturally occurring amino acid
GZFQXVLLS

SEQ ID NO: 173 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 174 - protein, 9 aa, Artificial Sequence
  Made in Lab - CRDH1 from anti-Fzd VH chain
FTFSSYAMH

SEQ ID NO: 175 - protein, 9 aa, Artificial Sequence
  Made in Lab - CRDH1 from anti-Fzd VH chain
FTFSNHYTS

SEQ ID NO: 176 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 177 - protein, 9 aa, Artificial Sequence
  Made in Lab - CRDH1 from anti-Fzd VH chain
GTFSSYAIS

SEQ ID NO: 178 - protein, 9 aa, Artificial Sequence
  Made in Lab - CRDH1 from anti-Fzd VH chain
GTFSSYAIS

SEQ ID NO: 179 - protein, 9 aa, Artificial Sequence
  Made in Lab - CRDH1 from anti-Fzd VH chain
DTFDTYAIS

SEQ ID NO: 180 - protein, 9 aa, Artificial Sequence
  Made in Lab - CRDH1 from anti-Fzd VH chain
GTFSSYAIS

SEQ ID NO: 181 - protein, 9 aa, Artificial Sequence
  Made in Lab - CRDH1 from anti-Fzd VH chain
YTFTNYFMH

SEQ ID NO: 182 - protein, 9 aa, Artificial Sequence
  Made in Lab - CRDH1 from anti-Fzd VH chain
GTFSSYAIS

SEQ ID NO: 183 - protein, 9 aa, Artificial Sequence
  Made in Lab - CRDH1 from anti-Fzd VH chain
FNFRMRPMH

SEQ ID NO: 184 - protein, 9 aa, Artificial Sequence
  Made in Lab - CRDH1 from anti-Fzd VH chain
YTFTAYYMH

SEQ ID NO: 185 - protein, 9 aa, Artificial Sequence
  Made in Lab - CRDH1 from anti-Fzd VH chain
YTFTNYYMH

SEQ ID NO: 186 - protein, 9 aa, Artificial Sequence
  Made in Lab - CRDH1 from anti-Fzd VH chain
FTVSDKYMS

SEQ ID NO: 187 - protein, 9 aa, Artificial Sequence
  Made in Lab - CRDH1 from anti-Fzd VH chain
FPFSSYAMS

SEQ ID NO: 188 - protein, 9 aa, Artificial Sequence
  Made in Lab - CRDH1 from anti-Fzd VH chain
FTFSSYAMH

SEQ ID NO: 189 - protein, 9 aa, Artificial Sequence
  Made in Lab - CRDH1 from anti-Fzd VH chain
YTFTGYYMH

SEQ ID NO: 190 - protein, 9 aa, Artificial Sequence
  Made in Lab - CRDH1 from anti-Fzd VH chain
YTFTGYYMH

SEQ ID NO: 191 - protein, 9 aa, Artificial Sequence
  Made in Lab - CRDH1 from anti-Fzd VH chain
FTFSNHYMS

SEQ ID NO: 192 - protein, 9 aa, Artificial Sequence
  Made in Lab - CRDH1 from anti-Fzd VH chain
YTFTSYYMH

SEQ ID NO: 193 - protein, 9 aa, Artificial Sequence
  Made in Lab - CRDH1 from anti-Fzd VH chain
FTFSNYAMH

SEQ ID NO: 194 - protein, 9 aa, Artificial Sequence
  Made in Lab - CRDH1 from anti-Fzd VH chain
FTFNNYAMS

SEQ ID NO: 195 - protein, 9 aa, Artificial Sequence
  Made in Lab - CRDH1 from anti-Fzd VH chain
YTFTRYAMH

SEQ ID NO: 196 - protein, 9 aa, Artificial Sequence
  Made in Lab - CRDH1 from anti-Fzd VH chain
YIFTNHYIH

SEQ ID NO: 197 - protein, 9 aa, Artificial Sequence
  Made in Lab - CRDH1 from anti-Fzd VH chain
GTFSSYAIN

SEQ ID NO: 198 - protein, 9 aa, Artificial Sequence
  Made in Lab - CRDH1 from anti-Fzd VH chain
YTFTSYGIS

SEQ ID NO: 199 - protein, 9 aa, Artificial Sequence
  Made in Lab - CRDH1 from anti-Fzd VH chain
YTFTGYYVH

SEQ ID NO: 200 - protein, 9 aa, Artificial Sequence
  Made in Lab - CRDH1 from anti-Fzd VH chain
FTFSSSWMH

SEQ ID NO: 201 - protein, 9 aa, Artificial Sequence
  Made in Lab - CRDH1 from anti-Fzd VH chain
FTFNNYZMS

SEQ ID NO: 202 - protein, 9 aa, Artificial Sequence
  Made in Lab - CRDH1 from anti-Fzd VH chain
FSFINYAMH

SEQ ID NO: 203 - protein, 9 aa, Artificial Sequence
  Made in Lab - CRDH1 from anti-Fzd VH chain
FTFNNYAMS

SEQ ID NO: 204 - protein, 9 aa, Artificial Sequence
  Made in Lab - CRDH1 from anti-Fzd VH chain
YTFVRYGIT

SEQ ID NO: 205 - protein, 9 aa, Artificial Sequence
  Made in Lab - CRDH1 from anti-Fzd VH chain
DTFSNYYMH

SEQ ID NO: 206 - protein, 9 aa, Artificial Sequence
  Made in Lab - CRDH1 from anti-Fzd VH chain
YTFTDYSLH

SEQ ID NO: 207 - protein, 9 aa, Artificial Sequence
  Made in Lab - CRDH1 from anti-Fzd VH chain
YTFSSYYMH

SEQ ID NO: 208 - protein, 9 aa, Artificial Sequence
  Made in Lab - CRDH1 from anti-Fzd VH chain
GTFSSYAIS

SEQ ID NO: 209 - protein, 9 aa, Artificial Sequence
  Made in Lab - CRDH1 from anti-Fzd VH chain
GTFSSYAIS

SEQ ID NO: 210 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 211 - protein, 9 aa, Artificial Sequence
  Made in Lab - CRDH1 from anti-Fzd VH chain
YTFTSYSMH

SEQ ID NO: 212 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 213 - protein, 9 aa, Artificial Sequence
  Made in Lab - CRDH1 from anti-Fzd VH chain
FSLSSSGMS

SEQ ID NO: 214 - protein, 9 aa, Artificial Sequence
  Made in Lab - CRDH1 from anti-Fzd VH chain
YTFSNYYMH

SEQ ID NO: 215 - protein, 9 aa, Artificial Sequence
  Made in Lab - CRDH1 from anti-Fzd VH chain
GTFSRYAIS

SEQ ID NO: 216 - protein, 9 aa, Artificial Sequence
  Made in Lab - CRDH1 from anti-Fzd VH chain
YTFTNYFFH

SEQ ID NO: 217 - protein, 9 aa, Artificial Sequence
  Made in Lab - CRDH1 from anti-Fzd VH chain
YTFTSYYMH

SEQ ID NO: 218 - protein, 9 aa, Artificial Sequence
  Made in Lab - CRDH1 from anti-Fzd VH chain
YTFTTHYMH

SEQ ID NO: 219 - protein, 9 aa, Artificial Sequence
  Made in Lab - CRDH1 from anti-Fzd VH chain
YTFSHHYVH

SEQ ID NO: 220 - protein, 9 aa, Artificial Sequence
  Made in Lab - CRDH1 from anti-Fzd VH chain
YSFTNYYLH

SEQ ID NO: 221 - protein, 9 aa, Artificial Sequence
  Made in Lab - CRDH1 from anti-Fzd VH chain
YTFSHYGMH

SEQ ID NO: 222 - protein, 9 aa, Artificial Sequence
  Made in Lab - CRDH1 from anti-Fzd VH chain
GTFSSYAIS

SEQ ID NO: 223 - protein, 9 aa, Artificial Sequence
  Made in Lab - CRDH1 from anti-Fzd VH chain
FTFSSFAMH

SEQ ID NO: 224 - protein, 9 aa, Artificial Sequence
  Made in Lab - CRDH1 from anti-Fzd VH chain
YDFINYYIH

SEQ ID NO: 225 - protein, 9 aa, Artificial Sequence
  Made in Lab - CRDH1 from anti-Fzd VH chain
YTFTYRYLH

SEQ ID NO: 226 - protein, 9 aa, Artificial Sequence
  Made in Lab - CRDH1 from anti-Fzd VH chain
YTFTSYYMH

SEQ ID NO: 227 - protein, 9 aa, Artificial Sequence
  Made in Lab - CRDH1 from anti-Fzd VH chain
FTFTSSAVQ

SEQ ID NO: 228 - protein, 9 aa, Artificial Sequence
  Made in Lab - CRDH1 from anti-Fzd VH chain
YTFTTHYMH

SEQ ID NO: 229 - protein, 9 aa, Artificial Sequence
  Made in Lab - CRDH1 from anti-Fzd VH chain
FTFGSHGMH

SEQ ID NO: 230 - protein, 9 aa, Artificial Sequence
  Made in Lab - CRDH1 from anti-Fzd VH chain
GSFTSHAVT

SEQ ID NO: 231 - protein, 9 aa, Artificial Sequence
  Made in Lab - CRDH1 from anti-Fzd VH chain
GTFSRNAIS

SEQ ID NO: 232 - protein, 9 aa, Artificial Sequence
  Made in Lab - CRDH1 from anti-Fzd VH chain
YTFTDNYIH

SEQ ID NO: 233 - protein, 9 aa, Artificial Sequence
  Made in Lab - CRDH1 from anti-Fzd VH chain
GRFSTYALS

SEQ ID NO: 234 - protein, 9 aa, Artificial Sequence
  Made in Lab - CRDH1 from anti-Fzd VH chain
FTYDDHAMH

SEQ ID NO: 235 - protein, 9 aa, Artificial Sequence
  Made in Lab - CRDH1 from anti-Fzd VH chain
YTFTSYYMH

SEQ ID NO: 236 - protein, 9 aa, Artificial Sequence
  Made in Lab - CRDH1 from anti-Fzd VH chain
YPFSNYYMH

SEQ ID NO: 237 - protein, 9 aa, Artificial Sequence
  Made in Lab - CRDH1 from anti-Fzd VH chain
YTFTTYWIH

SEQ ID NO: 238 - protein, 9 aa, Artificial Sequence
  Made in Lab - CRDH1 from anti-Fzd VH chain
FPFSSYGIH

SEQ ID NO: 239 - protein, 9 aa, Artificial Sequence
  Made in Lab - CRDH1 from anti-Fzd VH chain
YTFTYRYLH

SEQ ID NO: 240 - protein, 9 aa, Artificial Sequence
  Made in Lab - CRDH1 from anti-Fzd VH chain
FTFSSDAMH

SEQ ID NO: 241 - protein, 9 aa, Artificial Sequence
  Made in Lab - CRDH1 from anti-Fzd VH chain
FTFSTYPMH

SEQ ID NO: 242 - protein, 9 aa, Artificial Sequence
  Made in Lab - CRDH1 from anti-Fzd VH chain
YTFNSYYMH

SEQ ID NO: 243 - protein, 9 aa, Artificial Sequence
  Made in Lab - CRDH1 from anti-Fzd VH chain
GTFSSYAIS

SEQ ID NO: 244 - protein, 9 aa, Artificial Sequence
  Made in Lab - CRDH1 from anti-Fzd VH chain
YTFTSYYMH

SEQ ID NO: 245 - protein, 9 aa, Artificial Sequence
  Made in Lab - CRDH1 from anti-Fzd VH chain
YTFTSYYMH

SEQ ID NO: 246 - protein, 9 aa, Artificial Sequence
  Made in Lab - CRDH1 from anti-Fzd VH chain
YTFTGYYMH

SEQ ID NO: 247 - protein, 9 aa, Artificial Sequence
  Made in Lab - CRDH1 from anti-Fzd VH chain
YTFTSYYMH

SEQ ID NO: 248 - protein, 9 aa, Artificial Sequence
  Made in Lab - CRDH1 from anti-Fzd VH chain
YTFTGYYVH

SEQ ID NO: 249 - protein, 9 aa, Artificial Sequence
  Made in Lab - CRDH1 from anti-Fzd VH chain
YTFTNYYMH

SEQ ID NO: 250 - protein, 9 aa, Artificial Sequence
  Made in Lab - CRDH1 from anti-Fzd VH chain
YTFTNYYMH

SEQ ID NO: 251 - protein, 9 aa, Artificial Sequence
  Made in Lab - CRDH1 from anti-Fzd VH chain
YTFTGYYMH

SEQ ID NO: 252 - protein, 9 aa, Artificial Sequence
  Made in Lab - CRDH1 from anti-Fzd VH chain
YTFSSYYMH

SEQ ID NO: 253 - protein, 9 aa, Artificial Sequence
  Made in Lab - CRDH1 from anti-Fzd VH chain
YTFTGYYMH

SEQ ID NO: 254 - protein, 9 aa, Artificial Sequence
  Made in Lab - CRDH1 from anti-Fzd VH chain
YTFTGYYMH

SEQ ID NO: 255 - protein, 9 aa, Artificial Sequence
  Made in Lab - CRDH1 from anti-Fzd VH chain
YTFTGYYMH

SEQ ID NO: 256 - protein, 9 aa, Artificial Sequence
  Made in Lab - CRDH1 from anti-Fzd VH chain
YTFTGYYMH

SEQ ID NO: 257 - protein, 9 aa, Artificial Sequence
  Made in Lab - CRDH1 from anti-Fzd VH chain
FTFSNHYMS

SEQ ID NO: 258 - protein, 9 aa, Artificial Sequence
  Made in Lab - CRDH1 from anti-Fzd VH chain
YTFTSYYMH

SEQ ID NO: 259 - protein, 9 aa, Artificial Sequence
  Made in Lab - CRDH1 from anti-Fzd VH chain
FTFSNHYMS

SEQ ID NO: 260 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 261 - protein, 9 aa, Artificial Sequence
  Made in Lab - CRDH1 from anti-Fzd VH chain
YTFTSYYMH

SEQ ID NO: 262 - protein, 9 aa, Artificial Sequence
  Made in Lab - CRDH1 from anti-Fzd VH chain
YTFTSYYMH

SEQ ID NO: 263 - protein, 9 aa, Artificial Sequence
  Made in Lab - CRDH1 from anti-Fzd VH chain
FTFSNHYTS

SEQ ID NO: 264 - protein, 9 aa, Artificial Sequence
  Made in Lab - CRDH1 from anti-Fzd VH chain
YTFTSYYMH

SEQ ID NO: 265 - protein, 9 aa, Artificial Sequence
  Made in Lab - CRDH1 from anti-Fzd VH chain
YTFTGYYMH

SEQ ID NO: 266 - protein, 9 aa, Artificial Sequence
  Made in Lab - CRDH1 from anti-Fzd VH chain
YTFTNYYMH

SEQ ID NO: 267 - protein, 9 aa, Artificial Sequence
  Made in Lab - CRDH1 from anti-Fzd VH chain
FTFSSYAMH

SEQ ID NO: 268 - protein, 9 aa, Artificial Sequence
  Made in Lab - CRDH1 from anti-Fzd VH chain
FTFSSYGMH

SEQ ID NO: 269 - protein, 9 aa, Artificial Sequence
  Made in Lab - CRDH1 from anti-Fzd VH chain
YTFTSYYMH

SEQ ID NO: 270 - protein, 9 aa, Artificial Sequence
  Made in Lab - CRDH1 from anti-Fzd VH chain
FTFSSYGMH

SEQ ID NO: 271 - protein, 9 aa, Artificial Sequence
  Made in Lab - CRDH1 from anti-Fzd VH chain
YTFTSYYMH

SEQ ID NO: 272 - protein, 9 aa, Artificial Sequence
  Made in Lab - CRDH1 from anti-Fzd VH chain
YTFTGYYVH

SEQ ID NO: 273 - protein, 9 aa, Artificial Sequence
  Made in Lab - CRDH1 from anti-Fzd VH chain
FTFSNHYMS

SEQ ID NO: 274 - protein, 9 aa, Artificial Sequence
  Made in Lab - CRDH1 from anti-Fzd VH chain
FTFSNHYMS

SEQ ID NO: 275 - protein, 9 aa, Artificial Sequence
  Made in Lab - CRDH1 from anti-Fzd VH chain
YTFTNYYMH

SEQ ID NO: 276 - protein, 9 aa, Artificial Sequence
  Made in Lab - CRDH1 from anti-Fzd VH chain
YTFTAYYMH

SEQ ID NO: 277 - protein, 9 aa, Artificial Sequence
  Made in Lab - CRDH1 from anti-Fzd VH chain
YTFTSYYMH

SEQ ID NO: 278 - protein, 9 aa, Artificial Sequence
  Made in Lab - CRDH1 from anti-Fzd VH chain
YTFTGYYMH

SEQ ID NO: 279 - protein, 9 aa, Artificial Sequence
  Made in Lab - CRDH1 from anti-Fzd VH chain
YTFTGYYMH

SEQ ID NO: 280 - protein, 9 aa, Artificial Sequence
  Made in Lab - CRDH1 from anti-Fzd VH chain
YTFTGYYMH

SEQ ID NO: 281 - protein, 9 aa, Artificial Sequence
  Made in Lab - CRDH1 from anti-Fzd VH chain
YTFTSYGIS

SEQ ID NO: 282 - protein, 9 aa, Artificial Sequence
  Made in Lab - CRDH1 from anti-Fzd VH chain
FTFSNHYMS

SEQ ID NO: 283 - protein, 9 aa, Artificial Sequence
  Made in Lab - CRDH1 from anti-Fzd VH chain
YTFTSYYMH

SEQ ID NO: 284 - protein, 9 aa, Artificial Sequence
  Made in Lab - CRDH1 from anti-Fzd VH chain
YTFTSYYMH

SEQ ID NO: 285 - protein, 9 aa, Artificial Sequence
  Made in Lab - CRDH1 from anti-Fzd VH chain
FTFSSYGMH

SEQ ID NO: 286 - protein, 9 aa, Artificial Sequence
  Made in Lab - CRDH1 from anti-Fzd VH chain
YTFTNYYMH

SEQ ID NO: 287 - protein, 9 aa, Artificial Sequence
  Made in Lab - CRDH1 from anti-Fzd VH chain
YTFTGYYMH

SEQ ID NO: 288 - protein, 9 aa, Artificial Sequence
  Made in Lab - CRDH1 from anti-Fzd VH chain
YTFTTYYMH

SEQ ID NO: 289 - protein, 9 aa, Artificial Sequence
  Made in Lab - CRDH1 from anti-Fzd VH chain
YTFTSYYMH

SEQ ID NO: 290 - protein, 9 aa, Artificial Sequence
  Made in Lab - CRDH1 from anti-Fzd VH chain
YTFTGYYMH

SEQ ID NO: 291 - protein, 9 aa, Artificial Sequence
  Made in Lab - CRDH1 from anti-Fzd VH chain
YTFTGYYMH

SEQ ID NO: 292 - protein, 9 aa, Artificial Sequence
  Made in Lab - CRDH1 from anti-Fzd VH chain
YTFTSYYMH

SEQ ID NO: 293 - protein, 9 aa, Artificial Sequence
  Made in Lab - CRDH1 from anti-Fzd VH chain
YTFTGYYMH

SEQ ID NO: 294 - protein, 9 aa, Artificial Sequence
  Made in Lab - CRDH1 from anti-Fzd VH chain
FTFSSYAMH

SEQ ID NO: 295 - protein, 9 aa, Artificial Sequence
  Made in Lab - CRDH1 from anti-Fzd VH chain
FTFSSYAMH

SEQ ID NO: 296 - protein, 9 aa, Artificial Sequence
  Made in Lab - CRDH1 from anti-Fzd VH chain
YTFTGYYMH

SEQ ID NO: 297 - protein, 9 aa, Artificial Sequence
  Made in Lab - CRDH1 from anti-Fzd VH chain
YTFTTYYIH

SEQ ID NO: 298 - protein, 9 aa, Artificial Sequence
  Made in Lab - CRDH1 from anti-Fzd VH chain
YTFTGYYVH

SEQ ID NO: 299 - protein, 9 aa, Artificial Sequence
  Made in Lab - CRDH1 from anti-Fzd VH chain
YTFTNYYMH

SEQ ID NO: 300 - protein, 9 aa, Artificial Sequence
  Made in Lab - CRDH1 from anti-Fzd VH chain
YTFTGYYVH

SEQ ID NO: 301 - protein, 9 aa, Artificial Sequence
  Made in Lab - CRDH1 from anti-Fzd VH chain
YTFTGYYMH

SEQ ID NO: 302 - protein, 9 aa, Artificial Sequence
  Made in Lab - CRDH1 from anti-Fzd VH chain
YTFTSYYMH

SEQ ID NO: 303 - protein, 9 aa, Artificial Sequence
  Made in Lab - CRDH1 from anti-Fzd VH chain
YTFTSYYMH

SEQ ID NO: 304 - protein, 9 aa, Artificial Sequence
  Made in Lab - CRDH1 from anti-Fzd VH chain
YTFTSYYMH

SEQ ID NO: 305 - protein, 9 aa, Artificial Sequence
  Made in Lab - CRDH1 from anti-Fzd VH chain
YTFTSYYMH

SEQ ID NO: 306 - protein, 9 aa, Artificial Sequence
  Made in Lab - CRDH1 from anti-Fzd VH chain
YTFTGYYMH

SEQ ID NO: 307 - protein, 9 aa, Artificial Sequence
  Made in Lab - CRDH1 from anti-Fzd VH chain
YTFTGYYMH

SEQ ID NO: 308 - protein, 9 aa, Artificial Sequence
  Made in Lab - CRDH1 from anti-Fzd VH chain
YTFTGYYVH

SEQ ID NO: 309 - protein, 9 aa, Artificial Sequence
  Made in Lab - CRDH1 from anti-Fzd VH chain
GTFSSYAIS

SEQ ID NO: 310 - protein, 9 aa, Artificial Sequence
  Made in Lab - CRDH1 from anti-Fzd VH chain
YTFTGYYMH

SEQ ID NO: 311 - protein, 9 aa, Artificial Sequence
  Made in Lab - CRDH1 from anti-Fzd VH chain
FTFSSYAMH

SEQ ID NO: 312 - protein, 9 aa, Artificial Sequence
  Made in Lab - CRDH1 from anti-Fzd VH chain
YTFTGHYIH

SEQ ID NO: 313 - protein, 9 aa, Artificial Sequence
  Made in Lab - CRDH1 from anti-Fzd VH chain
FTFSNHYTS

SEQ ID NO: 314 - protein, 9 aa, Artificial Sequence
  Made in Lab - CRDH1 from anti-Fzd VH chain
YTFSAYYMN

SEQ ID NO: 315 - protein, 9 aa, Artificial Sequence
  Made in Lab - CRDH1 from anti-Fzd VH chain
FSVSSNYMT

SEQ ID NO: 316 - protein, 9 aa, Artificial Sequence
  Made in Lab - CRDH1 from anti-Fzd VH chain
GTFSSYAIS

SEQ ID NO: 317 - protein, 9 aa, Artificial Sequence
  Made in Lab - CRDH1 from anti-Fzd VH chain
GTFZZYZIZ

SEQ ID NO: 318 - protein, 9 aa, Artificial Sequence
  Made in Lab - CRDH1 from anti-Fzd VH chain
FTFSNHYTS

SEQ ID NO: 319 - protein, 9 aa, Artificial Sequence
  Made in Lab - CRDH1 from anti-Fzd VH chain
FSVSSNYMT

SEQ ID NO: 320 - protein, 9 aa, Artificial Sequence
  Made in Lab - CRDH1 from anti-Fzd VH chain
YTFASYDIN

SEQ ID NO: 321 - protein, 9 aa, Artificial Sequence
  Made in Lab - CRDH1 from anti-Fzd VH chain
YTFTGYYMH

SEQ ID NO: 322 - protein, 9 aa, Artificial Sequence
  Made in Lab - CRDH1 from anti-Fzd VH chain
YTFTGHYIH

SEQ ID NO: 323 - protein, 9 aa, Artificial Sequence
  Made in Lab - CRDH1 from anti-Fzd VH chain
GTFSSYAIS

SEQ ID NO: 324 - protein, 9 aa, Artificial Sequence
  Made in Lab - CRDH1 from anti-Fzd VH chain
YTFTSYFMH

SEQ ID NO: 325 - protein, 9 aa, Artificial Sequence
  Made in Lab - CRDH1 from anti-Fzd VH chain
YTFTSYYMH

SEQ ID NO: 326 - protein, 9 aa, Artificial Sequence
  Made in Lab - CRDH1 from anti-Fzd VH chain
FSVSSZYMT

SEQ ID NO: 327 - protein, 9 aa, Artificial Sequence
  Made in Lab - CRDH1 from anti-Fzd VH chain
GTFSSYAVS

SEQ ID NO: 328 - protein, 9 aa, Artificial Sequence
  Made in Lab - CRDH1 from anti-Fzd VH chain
FTFSSYAMS

SEQ ID NO: 329 - protein, 9 aa, Artificial Sequence
  Made in Lab - CRDH1 from anti-Fzd VH chain
FTFDDYAMH

SEQ ID NO: 330 - protein, 9 aa, Artificial Sequence
  Made in Lab - CRDH1 from anti-Fzd VH chain
GTFSSYAIS

SEQ ID NO: 331 - protein, 9 aa, Artificial Sequence
  Made in Lab - CRDH1 from anti-Fzd VH chain
YTFTSYYMH

SEQ ID NO: 332 - protein, 9 aa, Artificial Sequence
  Made in Lab - CRDH1 from anti-Fzd VH chain
YTFTSYYIH

SEQ ID NO: 333 - protein, 9 aa, Artificial Sequence
  Made in Lab - CRDH1 from anti-Fzd VH chain
FSFTSHGMH

SEQ ID NO: 334 - protein, 9 aa, Artificial Sequence
  Made in Lab - CRDH1 from anti-Fzd VH chain
YIFTGYYMH

SEQ ID NO: 335 - protein, 9 aa, Artificial Sequence
  Made in Lab - CRDH1 from anti-Fzd VH chain
GTFSGYAIS

SEQ ID NO: 336 - protein, 9 aa, Artificial Sequence
  Made in Lab - CRDH1 from anti-Fzd VH chain
GTFSDYYIH

SEQ ID NO: 337 - protein, 9 aa, Artificial Sequence
  Made in Lab - CRDH1 from anti-Fzd VH chain
FTFSSYAMH

SEQ ID NO: 338 - protein, 9 aa, Artificial Sequence
  Made in Lab - CRDH1 from anti-Fzd VH chain
FTFRTHAMH

SEQ ID NO: 339 - protein, 9 aa, Artificial Sequence
  Made in Lab - CRDH1 from anti-Fzd VH chain
YTFTTYSIH

SEQ ID NO: 340 - protein, 9 aa, Artificial Sequence
  Made in Lab - CRDH1 from anti-Fzd VH chain
YTFTGYYMH

SEQ ID NO: 341 - protein, 9 aa, Artificial Sequence
  Made in Lab - CRDH1 from anti-Fzd VH chain
YTFTGYSLH

SEQ ID NO: 342 - protein, 9 aa, Artificial Sequence
  Made in Lab - CRDH1 from anti-Fzd VH chain
YTFSNYYIH

SEQ ID NO: 343 - protein, 9 aa, Artificial Sequence
  Made in Lab - CRDH1 from anti-Fzd VH chain
FTFSDYYMS

SEQ ID NO: 344 - protein, 9 aa, Artificial Sequence
  Made in Lab - CRDH1 from anti-Fzd VH chain
GTFSSYAIS

SEQ ID NO: 345 - protein, 9 aa, Artificial Sequence
  Made in Lab - CRDH1 from anti-Fzd VH chain
GTFSNYAYS

SEQ ID NO: 346 - protein, 9 aa, Artificial Sequence
  Made in Lab - CRDH1 from anti-Fzd VH chain
DTFTRHYVH

SEQ ID NO: 347 - protein, 9 aa, Artificial Sequence
  Made in Lab - CRDH1 from anti-Fzd VH chain
YTFTNYYMH

SEQ ID NO: 348 - protein, 9 aa, Artificial Sequence
  Made in Lab - CRDH1 from anti-Fzd VH chain
YTFASYYIH

SEQ ID NO: 349 - protein, 9 aa, Artificial Sequence
  Made in Lab - CRDH1 from anti-Fzd VH chain
FTFSSYAMH

SEQ ID NO: 350 - protein, 9 aa, Artificial Sequence
  Made in Lab - CRDH1 from anti-Fzd VH chain
YTFNNYYMH

SEQ ID NO: 351 - protein, 9 aa, Artificial Sequence
  Made in Lab - CRDH1 from anti-Fzd VH chain
YTFTGYYMH

SEQ ID NO: 352 - protein, 9 aa, Artificial Sequence
  Made in Lab - CRDH1 from anti-Fzd VH chain
FTFGDYAMS

SEQ ID NO: 353 - protein, 9 aa, Artificial Sequence
  Made in Lab - CRDH1 from anti-Fzd VH chain
YTFTGYYMH

SEQ ID NO: 354 - protein, 9 aa, Artificial Sequence
  Made in Lab - CRDH1 from anti-Fzd VH chain
HTFSSYVLG

SEQ ID NO: 355 - protein, 9 aa, Artificial Sequence
  Made in Lab - CRDH1 from anti-Fzd VH chain
YTLTTYYMH

SEQ ID NO: 356 - protein, 9 aa, Artificial Sequence
  Made in Lab - CRDH1 from anti-Fzd VH chain
FTFSSYAMH

SEQ ID NO: 357 - protein, 9 aa, Artificial Sequence
  Made in Lab - CRDH1 from anti-Fzd VH chain
FTFSSYAMH

SEQ ID NO: 358 - protein, 9 aa, Artificial Sequence
  Made in Lab - CRDH1 from anti-Fzd VH chain
YTFTGNYMH

SEQ ID NO: 359 - protein, 9 aa, Artificial Sequence
  Made in Lab - CRDH1 from anti-Fzd VH chain
YTFTRYYMH

SEQ ID NO: 360 - protein, 9 aa, Artificial Sequence
  Made in Lab - CRDH1 from anti-Fzd VH chain
YTFTNYYVH

SEQ ID NO: 361 - protein, 9 aa, Artificial Sequence
  Made in Lab - CRDH1 from anti-Fzd VH chain
YTFTNHGIS

SEQ ID NO: 362 - protein, 9 aa, Artificial Sequence
  Made in Lab - CRDH1 from anti-Fzd VH chain
GAFSSYAIS

SEQ ID NO: 363 - protein, 9 aa, Artificial Sequence
  Made in Lab - CRDH1 from anti-Fzd VH chain
YTFTRYYLH

SEQ ID NO: 364 - protein, 9 aa, Artificial Sequence
  Made in Lab - CRDH1 from anti-Fzd VH chain
FTVSRNYMD

SEQ ID NO: 365 - protein, 9 aa, Artificial Sequence
  Made in Lab - CRDH1 from anti-Fzd VH chain
YTFTSYYMH

SEQ ID NO: 366 - protein, 9 aa, Artificial Sequence
  Made in Lab - CRDH1 from anti-Fzd VH chain
FAFSSYALH

SEQ ID NO: 367 - protein, 9 aa, Artificial Sequence
  Made in Lab - CRDH1 from anti-Fzd VH chain
YSFSSYYMH

SEQ ID NO: 368 - protein, 9 aa, Artificial Sequence
  Made in Lab - CRDH1 from anti-Fzd VH chain
YTFTSYYMH

SEQ ID NO: 369 - protein, 9 aa, Artificial Sequence
  Made in Lab - CRDH1 from anti-Fzd VH chain
FTFHNSAMH

SEQ ID NO: 370 - protein, 9 aa, Artificial Sequence
  Made in Lab - CRDH1 from anti-Fzd VH chain
FTFSSHGMH

SEQ ID NO: 371 - protein, 9 aa, Artificial Sequence
  Made in Lab - CRDH1 from anti-Fzd VH chain
YTFTSYDIN

SEQ ID NO: 372 - protein, 9 aa, Artificial Sequence
  Made in Lab - CRDH1 from anti-Fzd VH chain
FTFSSYAMS

SEQ ID NO: 373 - protein, 9 aa, Artificial Sequence
  Made in Lab - CRDH1 from anti-Fzd VH chain
GTFSSYAIS

SEQ ID NO: 374 - protein, 9 aa, Artificial Sequence
  Made in Lab - CRDH1 from anti-Fzd VH chain
YTFTGYYVH

SEQ ID NO: 375 - protein, 9 aa, Artificial Sequence
  Made in Lab - CRDH1 from anti-Fzd VH chain
DTFTSYYMH

SEQ ID NO: 376 - protein, 9 aa, Artificial Sequence
  Made in Lab - CRDH1 from anti-Fzd VH chain
GTFSGYAIS

SEQ ID NO: 377 - protein, 9 aa, Artificial Sequence
  Made in Lab - CRDH1 from anti-Fzd VH chain
YTFTNYYMH

SEQ ID NO: 378 - protein, 9 aa, Artificial Sequence
  Made in Lab - CRDH1 from anti-Fzd VH chain
YTFTSNYIH

SEQ ID NO: 379 - protein, 9 aa, Artificial Sequence
  Made in Lab - CRDH1 from anti-Fzd VH chain
FTFSGYYMH

SEQ ID NO: 380 - protein, 9 aa, Artificial Sequence
  Made in Lab - CRDH1 from anti-Fzd VH chain
FTFSSSAMH

SEQ ID NO: 381 - protein, 9 aa, Artificial Sequence
  Made in Lab - CRDH1 from anti-Fzd VH chain
YTFTSYYMH

SEQ ID NO: 382 - protein, 9 aa, Artificial Sequence
  Made in Lab - CRDH1 from anti-Fzd VH chain
FTFSSYAMH

SEQ ID NO: 383 - protein, 9 aa, Artificial Sequence
  Made in Lab - CRDH1 from anti-Fzd VH chain
YTFTDYYMH

SEQ ID NO: 384 - protein, 9 aa, Artificial Sequence
  Made in Lab - CRDH1 from anti-Fzd VH chain
FTFSSHSTH

SEQ ID NO: 385 - protein, 9 aa, Artificial Sequence
  Made in Lab - CRDH1 from anti-Fzd VH chain
GTFSNQAIS

SEQ ID NO: 386 - protein, 9 aa, Artificial Sequence
  Made in Lab - CRDH1 from anti-Fzd VH chain
YTFZAZHMH

SEQ ID NO: 387 - protein, 9 aa, Artificial Sequence
  Made in Lab - CRDH1 from anti-Fzd VH chain
FSFSSYGMT

SEQ ID NO: 388 - protein, 9 aa, Artificial Sequence
  Made in Lab - CRDH1 from anti-Fzd VH chain
FTFSSYAMH

SEQ ID NO: 389 - protein, 9 aa, Artificial Sequence
  Made in Lab - CRDH1 from anti-Fzd VH chain
YTFTGYYMH

SEQ ID NO: 390 - protein, 9 aa, Artificial Sequence
  Made in Lab - CRDH1 from anti-Fzd VH chain
YTFTSYYVH

SEQ ID NO: 391 - protein, 9 aa, Artificial Sequence
  Made in Lab - CRDH1 from anti-Fzd VH chain
YTFTSYYMH

SEQ ID NO: 392 - protein, 9 aa, Artificial Sequence
  Made in Lab - CRDH1 from anti-Fzd VH chain
YTFTNYYIH

SEQ ID NO: 393 - protein, 9 aa, Artificial Sequence
  Made in Lab - CRDH1 from anti-Fzd VH chain
YTFNNYYMH

SEQ ID NO: 394 - protein, 9 aa, Artificial Sequence
  Made in Lab - CRDH1 from anti-Fzd VH chain
FTFSSYAMH

SEQ ID NO: 395 - protein, 9 aa, Artificial Sequence
  Made in Lab - CRDH1 from anti-Fzd VH chain
YTFTGYYMH

SEQ ID NO: 396 - protein, 9 aa, Artificial Sequence
  Made in Lab - CRDH1 from anti-Fzd VH chain
DSFTNYYMH

SEQ ID NO: 397 - protein, 9 aa, Artificial Sequence
  Made in Lab - CRDH1 from anti-Fzd VH chain
YTFASYYVH

SEQ ID NO: 398 - protein, 9 aa, Artificial Sequence
  Made in Lab - CRDH1 from anti-Fzd VH chain
YTFTSYGIS

SEQ ID NO: 399 - protein, 9 aa, Artificial Sequence
  Made in Lab - CRDH1 from anti-Fzd VH chain
FTFSSYAMH

SEQ ID NO: 400 - protein, 9 aa, Artificial Sequence
  Made in Lab - CRDH1 from anti-Fzd VH chain
YTFTSYYMH

SEQ ID NO: 401 - protein, 9 aa, Artificial Sequence
  Made in Lab - CRDH1 from anti-Fzd VH chain
YTFTSYYMH

SEQ ID NO: 402 - protein, 9 aa, Artificial Sequence
  Made in Lab - CRDH1 from anti-Fzd VH chain
FIFSSYAMS

SEQ ID NO: 403 - protein, 9 aa, Artificial Sequence
  Made in Lab - CRDH1 from anti-Fzd VH chain
FRFSNYAMT

SEQ ID NO: 404 - protein, 9 aa, Artificial Sequence
  Made in Lab - CRDH1 from anti-Fzd VH chain
YTFTGYYLH

SEQ ID NO: 405 - protein, 9 aa, Artificial Sequence
  Made in Lab - CRDH1 from anti-Fzd VH chain
FTFSSYAMH

SEQ ID NO: 406 - protein, 9 aa, Artificial Sequence
  Made in Lab - CRDH1 from anti-Fzd VH chain
YTFTGYYMH

SEQ ID NO: 407 - protein, 9 aa, Artificial Sequence
  Made in Lab - CRDH1 from anti-Fzd VH chain
LSVGSNYMS

SEQ ID NO: 408 - protein, 9 aa, Artificial Sequence
  Made in Lab - CRDH1 from anti-Fzd VH chain
FTFSTYAMH

SEQ ID NO: 409 - protein, 9 aa, Artificial Sequence
  Made in Lab - CRDH1 from anti-Fzd VH chain
FAFSGSAMH

SEQ ID NO: 410 - protein, 9 aa, Artificial Sequence
  Made in Lab - CRDH1 from anti-Fzd VH chain
YTFTRHYVH

SEQ ID NO: 411 - protein, 9 aa, Artificial Sequence
  Made in Lab - CRDH1 from anti-Fzd VH chain
FTFSGSALH

SEQ ID NO: 412 - protein, 9 aa, Artificial Sequence
  Made in Lab - CRDH1 from anti-Fzd VH chain
NTFIGYNMH

SEQ ID NO: 413 - protein, 9 aa, Artificial Sequence
  Made in Lab - CRDH1 from anti-Fzd VH chain
YTFTNYYIH

SEQ ID NO: 414 - protein, 9 aa, Artificial Sequence
  Made in Lab - CRDH1 from anti-Fzd VH chain
FTFSSYAMH

SEQ ID NO: 415 - protein, 9 aa, Artificial Sequence
  Made in Lab - CRDH1 from anti-Fzd VH chain
YTFTRHYVH

SEQ ID NO: 416 - protein, 9 aa, Artificial Sequence
  Made in Lab - CRDH1 from anti-Fzd VH chain
YTFTSYGIS

SEQ ID NO: 417 - protein, 9 aa, Artificial Sequence
  Made in Lab - CRDH1 from anti-Fzd VH chain
YAFTGYYMH

SEQ ID NO: 418 - protein, 9 aa, Artificial Sequence
  Made in Lab - CRDH1 from anti-Fzd VH chain
YTFTSYYMH

SEQ ID NO: 419 - protein, 9 aa, Artificial Sequence
  Made in Lab - CRDH1 from anti-Fzd VH chain
YRFTGYYMH

SEQ ID NO: 420 - protein, 9 aa, Artificial Sequence
  Made in Lab - CRDH1 from anti-Fzd VH chain
YTFTGYYMH

SEQ ID NO: 421 - protein, 9 aa, Artificial Sequence
  Made in Lab - CRDH1 from anti-Fzd VH chain
FTFSSYAMH

SEQ ID NO: 422 - protein, 9 aa, Artificial Sequence
  Made in Lab - CRDH1 from anti-Fzd VH chain
FTFTNYYVH

SEQ ID NO: 423 - protein, 9 aa, Artificial Sequence
  Made in Lab - CRDH1 from anti-Fzd VH chain
GRFSTYALS

SEQ ID NO: 424 - protein, 9 aa, Artificial Sequence
  Made in Lab - CRDH1 from anti-Fzd VH chain
FSFSNYAMG

SEQ ID NO: 425 - protein, 9 aa, Artificial Sequence
  Made in Lab - CRDH1 from anti-Fzd VH chain
FTFSSYAMH

SEQ ID NO: 426 - protein, 9 aa, Artificial Sequence
  Made in Lab - CRDH1 from anti-Fzd VH chain
FTFSSYAMH

SEQ ID NO: 427 - protein, 9 aa, Artificial Sequence
  Made in Lab - CRDH1 from anti-Fzd VH chain
YTFTDYYIH

SEQ ID NO: 428 - protein, 9 aa, Artificial Sequence
  Made in Lab - CRDH1 from anti-Fzd VH chain
FTFSSYAMH

SEQ ID NO: 429 - protein, 9 aa, Artificial Sequence
  Made in Lab - CRDH1 from anti-Fzd VH chain
YTFTGYHIH

SEQ ID NO: 430 - protein, 9 aa, Artificial Sequence
  Made in Lab - CRDH1 from anti-Fzd VH chain
GTFSNYAIN

SEQ ID NO: 431 - protein, 9 aa, Artificial Sequence
  Made in Lab - CRDH1 from anti-Fzd VH chain
YTFTDYYMH

SEQ ID NO: 432 - protein, 9 aa, Artificial Sequence
  Made in Lab - CRDH1 from anti-Fzd VH chain
YTFTSNNMH

SEQ ID NO: 433 - protein, 9 aa, Artificial Sequence
  Made in Lab - CRDH1 from anti-Fzd VH chain
YTFTSYYMH

SEQ ID NO: 434 - protein, 9 aa, Artificial Sequence
  Made in Lab - CRDH1 from anti-Fzd VH chain
ZZFTANYIZ

SEQ ID NO: 435 - protein, 9 aa, Artificial Sequence
  Made in Lab - CRDH1 from anti-Fzd VH chain
YTFTSYGIS

SEQ ID NO: 436 - protein, 11 aa, Artificial Sequence
  Made in Lab - CRDH1 from anti-Fzd VH chain
DSVSNNNAAWN

SEQ ID NO: 437 - protein, 9 aa, Artificial Sequence
  Made in Lab - CRDH1 from anti-Fzd VH chain
YTFTANYIH

SEQ ID NO: 438 - protein, 9 aa, Artificial Sequence
  Made in Lab - CRDH1 from anti-Fzd VH chain
ZSFSSYVMZ

SEQ ID NO: 439 - protein, 9 aa, Artificial Sequence
  Made in Lab - CRDH1 from anti-Fzd VH chain
FTFSSYZMH

SEQ ID NO: 440 - protein, 9 aa, Artificial Sequence
  Made in Lab - CRDH1 from anti-Fzd VH chain
FTFSZYZMH

SEQ ID NO: 441 - protein, 9 aa, Artificial Sequence
  Made in Lab - CRDH1 from anti-Fzd VH chain
FTFSSYAMH

SEQ ID NO: 442 - protein, 9 aa, Artificial Sequence
  Made in Lab - CRDH1 from anti-Fzd VH chain
FTFRRHAMH

SEQ ID NO: 443 - protein, 9 aa, Artificial Sequence
  Made in Lab - CRDH1 from anti-Fzd VH chain
FTFZRYZLZ

SEQ ID NO: 444 - protein, 9 aa, Artificial Sequence
  Made in Lab - CRDH1 from anti-Fzd VH chain
FTFGDYAMZ

SEQ ID NO: 445 - protein, 9 aa, Artificial Sequence
  Made in Lab - CRDH1 from anti-Fzd VH chain
FTFSSYAMH

SEQ ID NO: 446 - protein, 9 aa, Artificial Sequence
  Made in Lab - CRDH1 from anti-Fzd VH chain
FTFSSYAMH

SEQ ID NO: 447 - protein, 11 aa, Artificial Sequence
  Made in Lab - CRDH1 from anti-Fzd VH chain
DSVSSSSAAWT

SEQ ID NO: 448 - protein, 9 aa, Artificial Sequence
  Made in Lab - CRDH1 from anti-Fzd VH chain
FTFSSYAMH

SEQ ID NO: 449 - protein, 9 aa, Artificial Sequence
  Made in Lab - CRDH1 from anti-Fzd VH chain
FTFSSYAMH

SEQ ID NO: 450 - protein, 9 aa, Artificial Sequence
  Made in Lab - CRDH1 from anti-Fzd VH chain
FTFSSYAMH

SEQ ID NO: 451 - protein, 9 aa, Artificial Sequence
  Made in Lab - CRDH1 from anti-Fzd VH chain
FTFSZYZMZ

SEQ ID NO: 452 - protein, 9 aa, Artificial Sequence
  Made in Lab - CRDH1 from anti-Fzd VH chain
FTFSSYAMH

SEQ ID NO: 453 - protein, 9 aa, Artificial Sequence
  Made in Lab - CRDH1 from anti-Fzd VH chain
FTFSSFGMH

SEQ ID NO: 454 - protein, 11 aa, Artificial Sequence
  Made in Lab - CRDH1 from anti-Fzd VH chain
DSVSSSSAAWT

SEQ ID NO: 455 - protein, 9 aa, Artificial Sequence
  Made in Lab - CRDH1 from anti-Fzd VH chain
FTFSTYDMH

SEQ ID NO: 456 - protein, 9 aa, Artificial Sequence
  Made in Lab - CRDH1 from anti-Fzd VH chain
FTFSSYZMH

SEQ ID NO: 457 - protein, 9 aa, Artificial Sequence
  Made in Lab - CRDH1 from anti-Fzd VH chain
FTFSSYAMH

SEQ ID NO: 458 - protein, 9 aa, Artificial Sequence
  Made in Lab - CRDH1 from anti-Fzd VH chain
FTFSSYAMH

SEQ ID NO: 459 - protein, 9 aa, Artificial Sequence
  Made in Lab - CRDH1 from anti-Fzd VH chain
FTFSSYAMH

SEQ ID NO: 460 - protein, 9 aa, Artificial Sequence
  Made in Lab - CRDH1 from anti-Fzd VH chain
FTFSSYAMH

SEQ ID NO: 461 - protein, 9 aa, Artificial Sequence
  Made in Lab - CRDH1 from anti-Fzd VH chain
FTFSSYAMS

SEQ ID NO: 462 - protein, 9 aa, Artificial Sequence
  Made in Lab - CRDH1 from anti-Fzd VH chain
FTFSSYAMH

SEQ ID NO: 463 - protein, 9 aa, Artificial Sequence
  Made in Lab - CRDH1 from anti-Fzd VH chain
YTFTSYYMH

SEQ ID NO: 464 - protein, 9 aa, Artificial Sequence
  Made in Lab - CRDH1 from anti-Fzd VH chain
FTFSSYAMH

SEQ ID NO: 465 - protein, 11 aa, Artificial Sequence
  Made in Lab - CRDH1 from anti-Fzd VH chain
GSISSSSYYWG

SEQ ID NO: 466 - protein, 9 aa, Artificial Sequence
  Made in Lab - CRDH1 from anti-Fzd VH chain
FTFSSYGMH

SEQ ID NO: 467 - protein, 9 aa, Artificial Sequence
  Made in Lab - CRDH1 from anti-Fzd VH chain
FTFSSYAMH

SEQ ID NO: 468 - protein, 9 aa, Artificial Sequence
  Made in Lab - CRDH1 from anti-Fzd VH chain
FTFSSYAMH

SEQ ID NO: 469 - protein, 9 aa, Artificial Sequence
  Made in Lab - CRDH1 from anti-Fzd VH chain
FTFSZZZMH

SEQ ID NO: 470 - protein, 9 aa, Artificial Sequence
  Made in Lab - CRDH1 from anti-Fzd VH chain
FTFSSYAMH

SEQ ID NO: 471 - protein, 9 aa, Artificial Sequence
  Made in Lab - CRDH1 from anti-Fzd VH chain
FTFSSYGMH

SEQ ID NO: 472 - protein, 9 aa, Artificial Sequence
  Made in Lab - CRDH1 from anti-Fzd VH chain
FTFSSYAMS

SEQ ID NO: 473 - protein, 9 aa, Artificial Sequence
  Made in Lab - CRDH1 from anti-Fzd VH chain
FTFSSYZZH

SEQ ID NO: 474 - protein, 9 aa, Artificial Sequence
  Made in Lab - CRDH1 from anti-Fzd VH chain
FTFSSYZMH

SEQ ID NO: 475 - protein, 9 aa, Artificial Sequence
  Made in Lab - CRDH1 from anti-Fzd VH chain
FTFSSYAMT

SEQ ID NO: 476 - protein, 9 aa, Artificial Sequence
  Made in Lab - CRDH1 from anti-Fzd VH chain
FTFSSYAMH

SEQ ID NO: 477 - protein, 9 aa, Artificial Sequence
  Made in Lab - CRDH1 from anti-Fzd VH chain
FTFSSYAMH

SEQ ID NO: 478 - protein, 9 aa, Artificial Sequence
  Made in Lab - CRDH1 from anti-Fzd VH chain
FTFSSYAMH

SEQ ID NO: 479 - protein, 9 aa, Artificial Sequence
  Made in Lab - CRDH1 from anti-Fzd VH chain
FTFSSYGMH

SEQ ID NO: 480 - protein, 9 aa, Artificial Sequence
  Made in Lab - CRDH1 from anti-Fzd VH chain
FTFIZYAMS

SEQ ID NO: 481 - protein, 9 aa, Artificial Sequence
  Made in Lab - CRDH1 from anti-Fzd VH chain
FTFSSYAMS

SEQ ID NO: 482 - protein, 9 aa, Artificial Sequence
  Made in Lab - CRDH1 from anti-Fzd VH chain
FTFGGYAMS

SEQ ID NO: 483 - protein, 9 aa, Artificial Sequence
  Made in Lab - CRDH1 from anti-Fzd VH chain
FIFSZYAMS

SEQ ID NO: 484 - protein, 9 aa, Artificial Sequence
  Made in Lab - CRDH1 from anti-Fzd VH chain
FTFSSYAMS

SEQ ID NO: 485 - protein, 9 aa, Artificial Sequence
  Made in Lab - CRDH1 from anti-Fzd VH chain
FTFSSYAMH

SEQ ID NO: 486 - protein, 9 aa, Artificial Sequence
  Made in Lab - CRDH1 from anti-Fzd VH chain
FTFSSYAMS

SEQ ID NO: 487 - protein, 9 aa, Artificial Sequence
  Made in Lab - CRDH1 from anti-Fzd VH chain
FTFSSYGMH

SEQ ID NO: 488 - protein, 9 aa, Artificial Sequence
  Made in Lab - CRDH1 from anti-Fzd VH chain
FTFSZYGMH

SEQ ID NO: 489 - protein, 9 aa, Artificial Sequence
  Made in Lab - CRDH1 from anti-Fzd VH chain
FTFSSYZMH

SEQ ID NO: 490 - protein, 9 aa, Artificial Sequence
  Made in Lab - CRDH1 from anti-Fzd VH chain
GTFSSYAIS

SEQ ID NO: 491 - protein, 9 aa, Artificial Sequence
  Made in Lab - CRDH1 from anti-Fzd VH chain
NTFTNYGIH

SEQ ID NO: 492 - protein, 9 aa, Artificial Sequence
  Made in Lab - CRDH1 from anti-Fzd VH chain
FTFSSYGMH

SEQ ID NO: 493 - protein, 9 aa, Artificial Sequence
  Made in Lab - CRDH1 from anti-Fzd VH chain
FTFSZZZMH

SEQ ID NO: 494 - protein, 9 aa, Artificial Sequence
  Made in Lab - CRDH1 from anti-Fzd VH chain
FTFSGYAMH

SEQ ID NO: 495 - protein, 9 aa, Artificial Sequence
  Made in Lab - CRDH1 from anti-Fzd VH chain
FTFSGYAMH

SEQ ID NO: 496 - protein, 9 aa, Artificial Sequence
  Made in Lab - CRDH1 from anti-Fzd VH chain
FTFSSYAMH

SEQ ID NO: 497 - protein, 9 aa, Artificial Sequence
  Made in Lab - CRDH1 from anti-Fzd VH chain
FTFSSYAMH

SEQ ID NO: 498 - protein, 9 aa, Artificial Sequence
  Made in Lab - CRDH1 from anti-Fzd VH chain
FTFSSYAMH

SEQ ID NO: 499 - protein, 9 aa, Artificial Sequence
  Made in Lab - CRDH1 from anti-Fzd VH chain
FTFSSYAMH

SEQ ID NO: 500 - protein, 9 aa, Artificial Sequence
  Made in Lab - CRDH1 from anti-Fzd VH chain
FTZSZYAMZ

SEQ ID NO: 501 - protein, 9 aa, Artificial Sequence
  Made in Lab - CRDH1 from anti-Fzd VH chain
FTFSSYAMS

SEQ ID NO: 502 - protein, 9 aa, Artificial Sequence
  Made in Lab - CRDH1 from anti-Fzd VH chain
FTFSSYGMH

SEQ ID NO: 503 - protein, 9 aa, Artificial Sequence
  Made in Lab - CRDH1 from anti-Fzd VH chain
YTFASYYIH

SEQ ID NO: 504 - protein, 9 aa, Artificial Sequence
  Made in Lab - CRDH1 from anti-Fzd VH chain
YTFTSYYMH

SEQ ID NO: 505 - protein, 9 aa, Artificial Sequence
  Made in Lab - CRDH1 from anti-Fzd VH chain
YTFTSYDIN

SEQ ID NO: 506 - protein, 9 aa, Artificial Sequence
  Made in Lab - CRDH1 from anti-Fzd VH chain
YTFTNYYMH

SEQ ID NO: 507 - protein, 9 aa, Artificial Sequence
  Made in Lab - CRDH1 from anti-Fzd VH chain
YTFTSYHVH

SEQ ID NO: 508 - protein, 9 aa, Artificial Sequence
  Made in Lab - CRDH1 from anti-Fzd VH chain
YTFRDYYMH

SEQ ID NO: 509 - protein, 9 aa, Artificial Sequence
  Made in Lab - CRDH1 from anti-Fzd VH chain
YTFTAYYMH

SEQ ID NO: 510 - protein, 9 aa, Artificial Sequence
  Made in Lab - CRDH1 from anti-Fzd VH chain
FTFSSSAMH

SEQ ID NO: 511 - protein, 9 aa, Artificial Sequence
  Made in Lab - CRDH1 from anti-Fzd VH chain
NTFIGYYVH

SEQ ID NO: 512 - protein, 9 aa, Artificial Sequence
  Made in Lab - CRDH1 from anti-Fzd VH chain
FTFSDYYMS

SEQ ID NO: 513 - protein, 9 aa, Artificial Sequence
  Made in Lab - CRDH1 from anti-Fzd VH chain
HTLNSYYMH

SEQ ID NO: 514 - protein, 9 aa, Artificial Sequence
  Made in Lab - CRDH1 from anti-Fzd VH chain
FTFSSHGMH

SEQ ID NO: 515 - protein, 9 aa, Artificial Sequence
  Made in Lab - CRDH1 from anti-Fzd VH chain
FTFSSYPMS

SEQ ID NO: 516 - protein, 9 aa, Artificial Sequence
  Made in Lab - CRDH1 from anti-Fzd VH chain
YTVTRSYMH

SEQ ID NO: 517 - protein, 9 aa, Artificial Sequence
  Made in Lab - CRDH1 from anti-Fzd VH chain
YTFTGYYMH

SEQ ID NO: 518 - protein, 9 aa, Artificial Sequence
  Made in Lab - CRDH1 from anti-Fzd VH chain
YTFTSYYMH

SEQ ID NO: 519 - protein, 9 aa, Artificial Sequence
  Made in Lab - CRDH1 from anti-Fzd VH chain
GTFSSHAIS

SEQ ID NO: 520 - protein, 9 aa, Artificial Sequence
  Made in Lab - CRDH1 from anti-Fzd VH chain
FTFSNAWMS

SEQ ID NO: 521 - protein, 9 aa, Artificial Sequence
  Made in Lab - CRDH1 from anti-Fzd VH chain
FTFSDYYMS

SEQ ID NO: 522 - protein, 9 aa, Artificial Sequence
  Made in Lab - CRDH1 from anti-Fzd VH chain
YTFTSYDIN

SEQ ID NO: 523 - protein, 9 aa, Artificial Sequence
  Made in Lab - CRDH1 from anti-Fzd VH chain
GTFTSYALN

SEQ ID NO: 524 - protein, 9 aa, Artificial Sequence
  Made in Lab - CRDH1 from anti-Fzd VH chain
GTFTNYHMH

SEQ ID NO: 525 - protein, 9 aa, Artificial Sequence
  Made in Lab - CRDH1 from anti-Fzd VH chain
YTFTNYYMH

SEQ ID NO: 526 - protein, 9 aa, Artificial Sequence
  Made in Lab - CRDH1 from anti-Fzd VH chain
YTFTTYYMH

SEQ ID NO: 527 - protein, 9 aa, Artificial Sequence
  Made in Lab - CRDH1 from anti-Fzd VH chain
DSFTTYYIH

SEQ ID NO: 528 - protein, 9 aa, Artificial Sequence
  Made in Lab - CRDH1 from anti-Fzd VH chain
YTFSTHYMH

SEQ ID NO: 529 - protein, 9 aa, Artificial Sequence
  Made in Lab - CRDH1 from anti-Fzd VH chain
YTFTSHAIS

SEQ ID NO: 530 - protein, 9 aa, Artificial Sequence
  Made in Lab - CRDH1 from anti-Fzd VH chain
FTFSSYAMH

SEQ ID NO: 531 - protein, 9 aa, Artificial Sequence
  Made in Lab - CRDH1 from anti-Fzd VH chain
GTFSSYAIS

SEQ ID NO: 532 - protein, 9 aa, Artificial Sequence
  Made in Lab - CRDH1 from anti-Fzd VH chain
GTFTGYAIN

SEQ ID NO: 533 - protein, 9 aa, Artificial Sequence
  Made in Lab - CRDH1 from anti-Fzd VH chain
FTFSSYWMH

SEQ ID NO: 534 - protein, 9 aa, Artificial Sequence
  Made in Lab - CRDH1 from anti-Fzd VH chain
YTFTSYYMH

SEQ ID NO: 535 - protein, 9 aa, Artificial Sequence
  Made in Lab - CRDH1 from anti-Fzd VH chain
YTFTGYYMH

SEQ ID NO: 536 - protein, 9 aa, Artificial Sequence
  Made in Lab - CRDH1 from anti-Fzd VH chain
YTFTKYYMH

SEQ ID NO: 537 - protein, 9 aa, Artificial Sequence
  Made in Lab - CRDH1 from anti-Fzd VH chain
GTFNNYALS

SEQ ID NO: 538 - protein, 9 aa, Artificial Sequence
  Made in Lab - CRDH1 from anti-Fzd VH chain
YTFTNYYMH

SEQ ID NO: 539 - protein, 9 aa, Artificial Sequence
  Made in Lab - CRDH1 from anti-Fzd VH chain
YTFTGHYMH

SEQ ID NO: 540 - protein, 9 aa, Artificial Sequence
  Made in Lab - CRDH1 from anti-Fzd VH chain
FTFSSYGMH

SEQ ID NO: 541 - protein, 9 aa, Artificial Sequence
  Made in Lab - CRDH1 from anti-Fzd VH chain
YTFSDHYMH

SEQ ID NO: 542 - protein, 9 aa, Artificial Sequence
  Made in Lab - CRDH1 from anti-Fzd VH chain
FTFSSYGMS

SEQ ID NO: 543 - protein, 9 aa, Artificial Sequence
  Made in Lab - CRDH1 from anti-Fzd VH chain
YTFTGYYMH

SEQ ID NO: 544 - protein, 9 aa, Artificial Sequence
  Made in Lab - CRDH1 from anti-Fzd VH chain
YTFTDYYIQ

SEQ ID NO: 545 - protein, 9 aa, Artificial Sequence
  Made in Lab - CRDH1 from anti-Fzd VH chain
YTFSGYGIS

SEQ ID NO: 546 - protein, 9 aa, Artificial Sequence
  Made in Lab - CRDH1 from anti-Fzd VH chain
  misc_feature (6)..(6): Xaa can be any naturally occurring amino acid
YPFIGXYLH

SEQ ID NO: 547 - protein, 9 aa, Artificial Sequence
  Made in Lab - CRDH1 from anti-Fzd VH chain
FTFSNAWMS

SEQ ID NO: 548 - protein, 9 aa, Artificial Sequence
  Made in Lab - CRDH1 from anti-Fzd VH chain
YTFTNYYMH

SEQ ID NO: 549 - protein, 9 aa, Artificial Sequence
  Made in Lab - CRDH1 from anti-Fzd VH chain
HTFTSYYMH

SEQ ID NO: 550 - protein, 9 aa, Artificial Sequence
  Made in Lab - CRDH1 from anti-Fzd VH chain
YTFTAYYVH

SEQ ID NO: 551 - protein, 9 aa, Artificial Sequence
  Made in Lab - CRDH1 from anti-Fzd VH chain
YTFTGYYMH

SEQ ID NO: 552 - protein, 9 aa, Artificial Sequence
  Made in Lab - CRDH1 from anti-Fzd VH chain
DTFTRYYIH

SEQ ID NO: 553 - protein, 9 aa, Artificial Sequence
  Made in Lab - CRDH1 from anti-Fzd VH chain
YTFTGYYMH

SEQ ID NO: 554 - protein, 9 aa, Artificial Sequence
  Made in Lab - CRDH1 from anti-Fzd VH chain
YTFTSYYMH

SEQ ID NO: 555 - protein, 9 aa, Artificial Sequence
  Made in Lab - CRDH1 from anti-Fzd VH chain
YTLTSFYMH

SEQ ID NO: 556 - protein, 9 aa, Artificial Sequence
  Made in Lab - CRDH1 from anti-Fzd VH chain
FTFSSYWMS

SEQ ID NO: 557 - protein, 9 aa, Artificial Sequence
  Made in Lab - CRDH1 from anti-Fzd VH chain
YTFTTYSMQ

SEQ ID NO: 558 - protein, 9 aa, Artificial Sequence
  Made in Lab - CRDH1 from anti-Fzd VH chain
YTFTGYFLH

SEQ ID NO: 559 - protein, 9 aa, Artificial Sequence
  Made in Lab - CRDH1 from anti-Fzd VH chain
NTFKGYYMH

SEQ ID NO: 560 - protein, 9 aa, Artificial Sequence
  Made in Lab - CRDH1 from anti-Fzd VH chain
  misc_feature (6)..(6): Xaa can be any naturally occurring amino acid
YTFPAXYMH

SEQ ID NO: 561 - protein, 9 aa, Artificial Sequence
  Made in Lab - CRDH1 from anti-Fzd VH chain
YTFTNYYVH

SEQ ID NO: 562 - protein, 9 aa, Artificial Sequence
  Made in Lab - CRDH1 from anti-Fzd VH chain
YTFTSYYMH

SEQ ID NO: 563 - protein, 9 aa, Artificial Sequence
  Made in Lab - CRDH1 from anti-Fzd VH chain
YTFTGYYMH

SEQ ID NO: 564 - protein, 10 aa, Artificial Sequence
  Made in Lab - CRDH1 from anti-Fzd VH chain
GYTFTDYYMN

SEQ ID NO: 565 - protein, 9 aa, Artificial Sequence
  Made in Lab - CRDH1 from anti-Fzd VH chain
GTFSSYAIS

SEQ ID NO: 566 - protein, 9 aa, Artificial Sequence
  Made in Lab - CRDH1 from anti-Fzd VH chain
YKFNSNAMN

SEQ ID NO: 567 - protein, 9 aa, Artificial Sequence
  Made in Lab - CRDH1 from anti-Fzd VH chain
GTFNIYAIS

SEQ ID NO: 568 - protein, 9 aa, Artificial Sequence
  Made in Lab - CRDH1 from anti-Fzd VH chain
YTFTDYHMH

SEQ ID NO: 569 - protein, 9 aa, Artificial Sequence
  Made in Lab - CRDH1 from anti-Fzd VH chain
YTFTSYYMH

SEQ ID NO: 570 - protein, 9 aa, Artificial Sequence
  Made in Lab - CRDH1 from anti-Fzd VH chain
YTFTSYYMN

SEQ ID NO: 571 - protein, 9 aa, Artificial Sequence
  Made in Lab - CRDH1 from anti-Fzd VH chain
YSFTSYGIT

SEQ ID NO: 572 - protein, 9 aa, Artificial Sequence
  Made in Lab - CRDH1 from anti-Fzd VH chain
YTVTDYYMH

SEQ ID NO: 573 - protein, 9 aa, Artificial Sequence
  Made in Lab - CRDH1 from anti-Fzd VH chain
YTFTTYYIH

SEQ ID NO: 574 - protein, 9 aa, Artificial Sequence
  Made in Lab - CRDH1 from anti-Fzd VH chain
STFISAYMH

SEQ ID NO: 575 - protein, 9 aa, Artificial Sequence
  Made in Lab - CRDH1 from anti-Fzd VH chain
YTFTSYYMH

SEQ ID NO: 576 - protein, 9 aa, Artificial Sequence
  Made in Lab - CRDH1 from anti-Fzd VH chain
YTFTSYYMH

SEQ ID NO: 577 - protein, 9 aa, Artificial Sequence
  Made in Lab - CRDH1 from anti-Fzd VH chain
YTFTSYDIN

SEQ ID NO: 578 - protein, 9 aa, Artificial Sequence
  Made in Lab - CRDH1 from anti-Fzd VH chain
GTFDTFAIS

SEQ ID NO: 579 - protein, 9 aa, Artificial Sequence
  Made in Lab - CRDH1 from anti-Fzd VH chain
YTFTSYDIN

SEQ ID NO: 580 - protein, 9 aa, Artificial Sequence
  Made in Lab - CRDH1 from anti-Fzd VH chain
YTFTGYFIH

SEQ ID NO: 581 - protein, 9 aa, Artificial Sequence
  Made in Lab - CRDH1 from anti-Fzd VH chain
YTFTSYYMH

SEQ ID NO: 582 - protein, 9 aa, Artificial Sequence
  Made in Lab - CRDH1 from anti-Fzd VH chain
YTFTGYYMH

SEQ ID NO: 583 - protein, 9 aa, Artificial Sequence
  Made in Lab - CRDH1 from anti-Fzd VH chain
YTFTSYYMH

SEQ ID NO: 584 - protein, 9 aa, Artificial Sequence
  Made in Lab - CRDH1 from anti-Fzd VH chain
YTFTNYYVH

SEQ ID NO: 585 - protein, 9 aa, Artificial Sequence
  Made in Lab - CRDH1 from anti-Fzd VH chain
YTFPNYYMH

SEQ ID NO: 586 - protein, 9 aa, Artificial Sequence
  Made in Lab - CRDH1 from anti-Fzd VH chain
YTFTSYYMH

SEQ ID NO: 587 - protein, 9 aa, Artificial Sequence
  Made in Lab - CRDH1 from anti-Fzd VH chain
YTFTSYYIH

SEQ ID NO: 588 - protein, 9 aa, Artificial Sequence
  Made in Lab - CRDH1 from anti-Fzd VH chain
YTFTSYYMH

SEQ ID NO: 589 - protein, 9 aa, Artificial Sequence
  Made in Lab - CRDH1 from anti-Fzd VH chain
YTFTSYYMH

SEQ ID NO: 590 - protein, 9 aa, Artificial Sequence
  Made in Lab - CRDH1 from anti-Fzd VH chain
YTFTNYYIH

SEQ ID NO: 591 - protein, 9 aa, Artificial Sequence
  Made in Lab - CRDH1 from anti-Fzd VH chain
YTVTDYYMH

SEQ ID NO: 592 - protein, 9 aa, Artificial Sequence
  Made in Lab - CRDH1 from anti-Fzd VH chain
YTFTRYAMN

SEQ ID NO: 593 - protein, 9 aa, Artificial Sequence
  Made in Lab - CRDH1 from anti-Fzd VH chain
YTFTSYYMH

SEQ ID NO: 594 - protein, 9 aa, Artificial Sequence
  Made in Lab - CRDH1 from anti-Fzd VH chain
YTFTSYYMH

SEQ ID NO: 595 - protein, 9 aa, Artificial Sequence
  Made in Lab - CRDH1 from anti-Fzd VH chain
YTZTDYYMH

SEQ ID NO: 596 - protein, 9 aa, Artificial Sequence
  Made in Lab - CRDH1 from anti-Fzd VH chain
YTFTDYYMH

SEQ ID NO: 597 - protein, 9 aa, Artificial Sequence
  Made in Lab - CRDH1 from anti-Fzd VH chain
YSFTGYYMH

SEQ ID NO: 598 - protein, 9 aa, Artificial Sequence
  Made in Lab - CRDH1 from anti-Fzd VH chain
YTFTSYYMH

SEQ ID NO: 599 - protein, 9 aa, Artificial Sequence
  Made in Lab - CRDH1 from anti-Fzd VH chain
YTFTSYYMH

SEQ ID NO: 600 - protein, 9 aa, Artificial Sequence
  Made in Lab - CRDH1 from anti-Fzd VH chain
YTFTSYYMH

SEQ ID NO: 601 - protein, 9 aa, Artificial Sequence
  Made in Lab - CRDH1 from anti-Fzd VH chain
YAFTSYYVH

SEQ ID NO: 602 - protein, 9 aa, Artificial Sequence
  Made in Lab - CRDH1 from anti-Fzd VH chain
YTFTDYYMH

SEQ ID NO: 603 - protein, 9 aa, Artificial Sequence
  Made in Lab - CRDH1 from anti-Fzd VH chain
YTFTGYYMH

SEQ ID NO: 604 - protein, 9 aa, Artificial Sequence
  Made in Lab - CRDH1 from anti-Fzd VH chain
YTFTSYFMH

SEQ ID NO: 605 - protein, 9 aa, Artificial Sequence
  Made in Lab - CRDH1 from anti-Fzd VH chain
YTFTSYYMH

SEQ ID NO: 606 - protein, 9 aa, Artificial Sequence
  Made in Lab - CRDH1 from anti-Fzd VH chain
YTFTSYYMH

SEQ ID NO: 607 - protein, 9 aa, Artificial Sequence
  Made in Lab - CRDH1 from anti-Fzd VH chain
YTFTGYYMH

SEQ ID NO: 608 - protein, 9 aa, Artificial Sequence
  Made in Lab - CRDH1 from anti-Fzd VH chain
YTFTSYFMH

SEQ ID NO: 609 - protein, 9 aa, Artificial Sequence
  Made in Lab - CRDH1 from anti-Fzd VH chain
YTVTSHYMN

SEQ ID NO: 610 - protein, 9 aa, Artificial Sequence
  Made in Lab - CRDH1 from anti-Fzd VH chain
GTFSSYAIS

SEQ ID NO: 611 - protein, 9 aa, Artificial Sequence
  Made in Lab - CRDH1 from anti-Fzd VH chain
YTFTNYYMH

SEQ ID NO: 612 - protein, 9 aa, Artificial Sequence
  Made in Lab - CRDH1 from anti-Fzd VH chain
GAFSSYAIS

SEQ ID NO: 613 - protein, 9 aa, Artificial Sequence
  Made in Lab - CRDH1 from anti-Fzd VH chain
YTVTDYYMH

SEQ ID NO: 614 - protein, 9 aa, Artificial Sequence
  Made in Lab - CRDH1 from anti-Fzd VH chain
YTFTGYYMH

SEQ ID NO: 615 - protein, 9 aa, Artificial Sequence
  Made in Lab - CRDH1 from anti-Fzd VH chain
YTFTTYYVH

SEQ ID NO: 616 - protein, 9 aa, Artificial Sequence
  Made in Lab - CRDH1 from anti-Fzd VH chain
YTFTSYYMH

SEQ ID NO: 617 - protein, 9 aa, Artificial Sequence
  Made in Lab - CRDH1 from anti-Fzd VH chain
YTFTGYYMH

SEQ ID NO: 618 - protein, 9 aa, Artificial Sequence
  Made in Lab - CRDH1 from anti-Fzd VH chain
YTVTDYYMH

SEQ ID NO: 619 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 620 - protein, 9 aa, Artificial Sequence
  Made in Lab - CRDH1 from anti-Fzd VH chain
YSFTZYYMH

SEQ ID NO: 621 - protein, 9 aa, Artificial Sequence
  Made in Lab - CRDH1 from anti-Fzd VH chain
YTFTSYYIH

SEQ ID NO: 622 - protein, 9 aa, Artificial Sequence
  Made in Lab - CRDH1 from anti-Fzd VH chain
YTFTGYYMH

SEQ ID NO: 623 - protein, 9 aa, Artificial Sequence
  Made in Lab - CRDH1 from anti-Fzd VH chain
YTFTSYYMH

SEQ ID NO: 624 - protein, 9 aa, Artificial Sequence
  Made in Lab - CRDH1 from anti-Fzd VH chain
YTFTGYYMH

SEQ ID NO: 625 - protein, 9 aa, Artificial Sequence
  Made in Lab - CRDH1 from anti-Fzd VH chain
YTLTSYYIH

SEQ ID NO: 626 - protein, 9 aa, Artificial Sequence
  Made in Lab - CRDH1 from anti-Fzd VH chain
YTFTSYYMH

SEQ ID NO: 627 - protein, 9 aa, Artificial Sequence
  Made in Lab - CRDH1 from anti-Fzd VH chain
YTVTDYYMH

SEQ ID NO: 628 - protein, 9 aa, Artificial Sequence
  Made in Lab - CRDH1 from anti-Fzd VH chain
YTFTSYYMH

SEQ ID NO: 629 - protein, 9 aa, Artificial Sequence
  Made in Lab - CRDH1 from anti-Fzd VH chain
YTFTZYYMH

SEQ ID NO: 630 - protein, 9 aa, Artificial Sequence
  Made in Lab - CRDH1 from anti-Fzd VH chain
YTFTSYYMH

SEQ ID NO: 631 - protein, 9 aa, Artificial Sequence
  Made in Lab - CRDH1 from anti-Fzd VH chain
YTFTDYYMH

SEQ ID NO: 632 - protein, 9 aa, Artificial Sequence
  Made in Lab - CRDH1 from anti-Fzd VH chain
YTFTDYYIH

SEQ ID NO: 633 - protein, 9 aa, Artificial Sequence
  Made in Lab - CRDH1 from anti-Fzd VH chain
YTFTGNFIH

SEQ ID NO: 634 - protein, 9 aa, Artificial Sequence
  Made in Lab - CRDH1 from anti-Fzd VH chain
YTVTDYYMH

SEQ ID NO: 635 - protein, 9 aa, Artificial Sequence
  Made in Lab - CRDH1 from anti-Fzd VH chain
GTFSSYAIS

SEQ ID NO: 636 - protein, 9 aa, Artificial Sequence
  Made in Lab - CRDH1 from anti-Fzd VH chain
YTFTSYDIN

SEQ ID NO: 637 - protein, 9 aa, Artificial Sequence
  Made in Lab - CRDH1 from anti-Fzd VH chain
YTFTSYYMH

SEQ ID NO: 638 - protein, 9 aa, Artificial Sequence
  Made in Lab - CRDH1 from anti-Fzd VH chain
YTFTDYYMH

SEQ ID NO: 639 - protein, 9 aa, Artificial Sequence
  Made in Lab - CRDH1 from anti-Fzd VH chain
YTFTGYYMH

SEQ ID NO: 640 - protein, 9 aa, Artificial Sequence
  Made in Lab - CRDH1 from anti-Fzd VH chain
YTFTZYYMH

SEQ ID NO: 641 - protein, 9 aa, Artificial Sequence
  Made in Lab - CRDH1 from anti-Fzd VH chain
YSFTSYFVH

SEQ ID NO: 642 - protein, 9 aa, Artificial Sequence
  Made in Lab - CRDH1 from anti-Fzd VH chain
YSFTSYYMH

SEQ ID NO: 643 - protein, 9 aa, Artificial Sequence
  Made in Lab - CRDH1 from anti-Fzd VH chain
YTFTSHYMH

SEQ ID NO: 644 - protein, 9 aa, Artificial Sequence
  Made in Lab - CRDH1 from anti-Fzd VH chain
YTFSDYYIH

SEQ ID NO: 645 - protein, 9 aa, Artificial Sequence
  Made in Lab - CRDH1 from anti-Fzd VH chain
YTFTNYYMH

SEQ ID NO: 646 - protein, 9 aa, Artificial Sequence
  Made in Lab - CRDH1 from anti-Fzd VH chain
YTFZSYYMH

SEQ ID NO: 647 - protein, 9 aa, Artificial Sequence
  Made in Lab - CRDH1 from anti-Fzd VH chain
YTFTSYYMH

SEQ ID NO: 648 - protein, 9 aa, Artificial Sequence
  Made in Lab - CRDH1 from anti-Fzd VH chain
YTVTDYYMH

SEQ ID NO: 649 - protein, 9 aa, Artificial Sequence
  Made in Lab - CRDH1 from anti-Fzd VH chain
YTFTSYYMH

SEQ ID NO: 650 - protein, 9 aa, Artificial Sequence
  Made in Lab - CRDH1 from anti-Fzd VH chain
YTFPNYYMH

SEQ ID NO: 651 - protein, 9 aa, Artificial Sequence
  Made in Lab - CRDH1 from anti-Fzd VH chain
YTFTNYYLH

SEQ ID NO: 652 - protein, 9 aa, Artificial Sequence
  Made in Lab - CRDH1 from anti-Fzd VH chain
YTFTSYYMH

SEQ ID NO: 653 - protein, 9 aa, Artificial Sequence
  Made in Lab - CRDH1 from anti-Fzd VH chain
YSFTGFYMH

SEQ ID NO: 654 - protein, 9 aa, Artificial Sequence
  Made in Lab - CRDH1 from anti-Fzd VH chain
YTFTSYYMH

SEQ ID NO: 655 - protein, 9 aa, Artificial Sequence
  Made in Lab - CRDH1 from anti-Fzd VH chain
YSFTSYYMH

SEQ ID NO: 656 - protein, 9 aa, Artificial Sequence
  Made in Lab - CRDH1 from anti-Fzd VH chain
ZTFSNYAIZ

SEQ ID NO: 657 - protein, 9 aa, Artificial Sequence
  Made in Lab - CRDH1 from anti-Fzd VH chain
YTZTDYYMH

SEQ ID NO: 658 - protein, 9 aa, Artificial Sequence
  Made in Lab - CRDH1 from anti-Fzd VH chain
GTFSNYAIS

SEQ ID NO: 659 - protein, 9 aa, Artificial Sequence
  Made in Lab - CRDH1 from anti-Fzd VH chain
YTFTGHYMH

SEQ ID NO: 660 - protein, 9 aa, Artificial Sequence
  Made in Lab - CRDH1 from anti-Fzd VH chain
YTFTSNYVH

SEQ ID NO: 661 - protein, 9 aa, Artificial Sequence
  Made in Lab - CRDH1 from anti-Fzd VH chain
YTFTSYYVH

SEQ ID NO: 662 - protein, 9 aa, Artificial Sequence
  Made in Lab - CRDH1 from anti-Fzd VH chain
YTFTNSYIH

SEQ ID NO: 663 - protein, 9 aa, Artificial Sequence
  Made in Lab - CRDH1 from anti-Fzd VH chain
YTFTSYYMH

SEQ ID NO: 664 - protein, 9 aa, Artificial Sequence
  Made in Lab - CRDH1 from anti-Fzd VH chain
YTFTNYYIN

SEQ ID NO: 665 - protein, 9 aa, Artificial Sequence
  Made in Lab - CRDH1 from anti-Fzd VH chain
YTFTGYYMH

SEQ ID NO: 666 - protein, 9 aa, Artificial Sequence
  Made in Lab - CRDH1 from anti-Fzd VH chain
YTFADYNLH

SEQ ID NO: 667 - protein, 9 aa, Artificial Sequence
  Made in Lab - CRDH1 from anti-Fzd VH chain
YTFTSYDMH

SEQ ID NO: 668 - protein, 9 aa, Artificial Sequence
  Made in Lab - CRDH1 from anti-Fzd VH chain
YTFTSYYMH

SEQ ID NO: 669 - protein, 9 aa, Artificial Sequence
  Made in Lab - CRDH1 from anti-Fzd VH chain
FTFSSYWMH

SEQ ID NO: 670 - protein, 9 aa, Artificial Sequence
  Made in Lab - CRDH1 from anti-Fzd VH chain
YTFTNYYIH

SEQ ID NO: 671 - protein, 9 aa, Artificial Sequence
  Made in Lab - CRDH1 from anti-Fzd VH chain
YTFTHHSIH

SEQ ID NO: 672 - protein, 9 aa, Artificial Sequence
  Made in Lab - CRDH1 from anti-Fzd VH chain
GTFSSYAIS

SEQ ID NO: 673 - protein, 9 aa, Artificial Sequence
  Made in Lab - CRDH1 from anti-Fzd VH chain
LSFGDYAIH

SEQ ID NO: 674 - protein, 9 aa, Artificial Sequence
  Made in Lab - CRDH1 from anti-Fzd VH chain
FTFSSYGMH

SEQ ID NO: 675 - protein, 9 aa, Artificial Sequence
  Made in Lab - CRDH1 from anti-Fzd VH chain
FTFSSSAMH

SEQ ID NO: 676 - protein, 9 aa, Artificial Sequence
  Made in Lab - CRDH1 from anti-Fzd VH chain
FSFTRYDMH

SEQ ID NO: 677 - protein, 9 aa, Artificial Sequence
  Made in Lab - CRDH1 from anti-Fzd VH chain
YTFTDYYMH

SEQ ID NO: 678 - protein, 9 aa, Artificial Sequence
  Made in Lab - CRDH1 from anti-Fzd VH chain
YTLASYGIS

SEQ ID NO: 679 - protein, 9 aa, Artificial Sequence
  Made in Lab - CRDH1 from anti-Fzd VH chain
FSFRSYAMT

SEQ ID NO: 680 - protein, 9 aa, Artificial Sequence
  Made in Lab - CRDH1 from anti-Fzd VH chain
FTFDDYAMH

SEQ ID NO: 681 - protein, 9 aa, Artificial Sequence
  Made in Lab - CRDH1 from anti-Fzd VH chain
GTFSSYAIS

SEQ ID NO: 682 - protein, 9 aa, Artificial Sequence
  Made in Lab - CRDH1 from anti-Fzd VH chain
FTFSSYGMH

SEQ ID NO: 683 - protein, 9 aa, Artificial Sequence
  Made in Lab - CRDH1 from anti-Fzd VH chain
YTFTNYYMH

SEQ ID NO: 684 - protein, 9 aa, Artificial Sequence
  Made in Lab - CRDH1 from anti-Fzd VH chain
FTFSSHAMH

SEQ ID NO: 685 - protein, 9 aa, Artificial Sequence
  Made in Lab - CRDH1 from anti-Fzd VH chain
FTFSSHAMH

SEQ ID NO: 686 - protein, 9 aa, Artificial Sequence
  Made in Lab - CRDH1 from anti-Fzd VH chain
YTFTSYYVH

SEQ ID NO: 687 - protein, 9 aa, Artificial Sequence
  Made in Lab - CRDH1 from anti-Fzd VH chain
YTFTSYYMH

SEQ ID NO: 688 - protein, 9 aa, Artificial Sequence
  Made in Lab - CRDH1 from anti-Fzd VH chain
YTFTENEMH

SEQ ID NO: 689 - protein, 9 aa, Artificial Sequence
  Made in Lab - CRDH1 from anti-Fzd VH chain
GTFSSLDIN

SEQ ID NO: 690 - protein, 9 aa, Artificial Sequence
  Made in Lab - CRDH1 from anti-Fzd VH chain
FTFSSYGIH

SEQ ID NO: 691 - protein, 9 aa, Artificial Sequence
  Made in Lab - CRDH1 from anti-Fzd VH chain
GTFTSYPIS

SEQ ID NO: 692 - protein, 9 aa, Artificial Sequence
  Made in Lab - CRDH1 from anti-Fzd VH chain
GTFSSYAIS

SEQ ID NO: 693 - protein, 9 aa, Artificial Sequence
  Made in Lab - CRDH1 from anti-Fzd VH chain
YTFSDYYMY

SEQ ID NO: 694 - protein, 9 aa, Artificial Sequence
  Made in Lab - CRDH1 from anti-Fzd VH chain
YTFTSYYMH

SEQ ID NO: 695 - protein, 9 aa, Artificial Sequence
  Made in Lab - CRDH1 from anti-Fzd VH chain
YTFTNYDIN

SEQ ID NO: 696 - protein, 9 aa, Artificial Sequence
  Made in Lab - CRDH1 from anti-Fzd VH chain
LSVSNNYMS

SEQ ID NO: 697 - protein, 9 aa, Artificial Sequence
  Made in Lab - CRDH1 from anti-Fzd VH chain
GTFSSYAFS

SEQ ID NO: 698 - protein, 9 aa, Artificial Sequence
  Made in Lab - CRDH1 from anti-Fzd VH chain
FTFSDYYMS

SEQ ID NO: 699 - protein, 9 aa, Artificial Sequence
  Made in Lab - CRDH1 from anti-Fzd VH chain
YTFANYGIS

SEQ ID NO: 700 - protein, 9 aa, Artificial Sequence
  Made in Lab - CRDH1 from anti-Fzd VH chain
YTFTSYYIH

SEQ ID NO: 701 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 702 - protein, 9 aa, Artificial Sequence
  Made in Lab - CRDH1 from anti-Fzd VH chain
FTFSSYWMH

SEQ ID NO: 703 - protein, 9 aa, Artificial Sequence
  Made in Lab - CRDH1 from anti-Fzd VH chain
FTFSSYGMH

SEQ ID NO: 704 - protein, 9 aa, Artificial Sequence
  Made in Lab - CRDH1 from anti-Fzd VH chain
YTFTDYYMH

SEQ ID NO: 705 - protein, 9 aa, Artificial Sequence
  Made in Lab - CRDH1 from anti-Fzd VH chain
  misc_feature (7)..(7): Xaa can be any naturally occurring amino acid
FTFSSYXMT

SEQ ID NO: 706 - protein, 9 aa, Artificial Sequence
  Made in Lab - CRDH1 from anti-Fzd VH chain
FTVGSWYMS

SEQ ID NO: 707 - protein, 9 aa, Artificial Sequence
  Made in Lab - CRDH1 from anti-Fzd VH chain
YTFTSYYLH

SEQ ID NO: 708 - protein, 9 aa, Artificial Sequence
  Made in Lab - CRDH1 from anti-Fzd VH chain
YTFTGYYMH

SEQ ID NO: 709 - protein, 9 aa, Artificial Sequence
  Made in Lab - CRDH1 from anti-Fzd VH chain
FTFDDYAMH

SEQ ID NO: 710 - protein, 9 aa, Artificial Sequence
  Made in Lab - CRDH1 from anti-Fzd VH chain
YTFTNYYMH

SEQ ID NO: 711 - protein, 9 aa, Artificial Sequence
  Made in Lab - CRDH1 from anti-Fzd VH chain
FTFSRHGMH

SEQ ID NO: 712 - protein, 9 aa, Artificial Sequence
  Made in Lab - CRDH1 from anti-Fzd VH chain
GTFSSYAIS

SEQ ID NO: 713 - protein, 9 aa, Artificial Sequence
  Made in Lab - CRDH1 from anti-Fzd VH chain
YTFTSYYMH

SEQ ID NO: 714 - protein, 9 aa, Artificial Sequence
  Made in Lab - CRDH1 from anti-Fzd VH chain
FTVSPYWMT

SEQ ID NO: 715 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 716 - protein, 9 aa, Artificial Sequence
  Made in Lab - CRDH1 from anti-Fzd VH chain
FTFSDYWMS

SEQ ID NO: 717 - protein, 9 aa, Artificial Sequence
  Made in Lab - CRDH1 from anti-Fzd VH chain
FTFSSYAMH

SEQ ID NO: 718 - protein, 9 aa, Artificial Sequence
  Made in Lab - CRDH1 from anti-Fzd VH chain
YTFTTSYIH

SEQ ID NO: 719 - protein, 9 aa, Artificial Sequence
  Made in Lab - CRDH1 from anti-Fzd VH chain
FTFSSSAKH

SEQ ID NO: 720 - protein, 9 aa, Artificial Sequence
  Made in Lab - CRDH1 from anti-Fzd VH chain
FTFSGYGMH

SEQ ID NO: 721 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 722 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 723 - protein, 9 aa, Artificial Sequence
  Made in Lab - CRDH1 from anti-Fzd VH chain
YTFTNYYMH

SEQ ID NO: 724 - protein, 9 aa, Artificial Sequence
  Made in Lab - CRDH1 from anti-Fzd VH chain
YTFTGYYMH

SEQ ID NO: 725 - protein, 9 aa, Artificial Sequence
  Made in Lab - CRDH1 from anti-Fzd VH chain
YTFTNYYMH

SEQ ID NO: 726 - protein, 9 aa, Artificial Sequence
  Made in Lab - CRDH1 from anti-Fzd VH chain
FTFSNHYTS

SEQ ID NO: 727 - protein, 9 aa, Artificial Sequence
  Made in Lab - CRDH1 from anti-Fzd VH chain
  misc_feature (7)..(7): Xaa can be any naturally occurring amino acid
FTFSSYXMS

SEQ ID NO: 728 - protein, 11 aa, Artificial Sequence
  Made in Lab - CRDH1 from anti-Fzd VH chain
DSVSSNSAAWN

SEQ ID NO: 729 - protein, 9 aa, Artificial Sequence
  Made in Lab - CRDH1 from anti-Fzd VH chain
FTFSSYGMH

SEQ ID NO: 730 - protein, 13 aa, Artificial Sequence
  Made in Lab - CRDH2 from anti-Fzd VH chain
GVIKPSGGSTSYA

SEQ ID NO: 731 - protein, 13 aa, Artificial Sequence
  Made in Lab - CRDH2 from anti-Fzd VH chain
GWINPNSGGTNYA

SEQ ID NO: 732 - protein, 13 aa, Artificial Sequence
  Made in Lab - CRDH2 from anti-Fzd VH chain
GIINPSGGGTSYA

SEQ ID NO: 733 - protein, 13 aa, Artificial Sequence
  Made in Lab - CRDH2 from anti-Fzd VH chain
GIINPSGGGTSYA

SEQ ID NO: 734 - protein, 13 aa, Artificial Sequence
  Made in Lab - CRDH2 from anti-Fzd VH chain
GIINPSGGSTSYA

SEQ ID NO: 735 - protein, 13 aa, Artificial Sequence
  Made in Lab - CRDH2 from anti-Fzd VH chain
GIINPSGGSTSYA

SEQ ID NO: 736 - protein, 13 aa, Artificial Sequence
  Made in Lab - CRDH2 from anti-Fzd VH chain
GGIIPIFGTANYA

SEQ ID NO: 737 - protein, 13 aa, Artificial Sequence
  Made in Lab - CRDH2 from anti-Fzd VH chain
GIIKPSGDSTSYA

SEQ ID NO: 738 - protein, 13 aa, Artificial Sequence
  Made in Lab - CRDH2 from anti-Fzd VH chain
GIINPSGGSTSYA

SEQ ID NO: 739 - protein, 13 aa, Artificial Sequence
  Made in Lab - CRDH2 from anti-Fzd VH chain
GIINPSGGSTSYA

SEQ ID NO: 740 - protein, 13 aa, Artificial Sequence
  Made in Lab - CRDH2 from anti-Fzd VH chain
GWMNPDSGHTGYA

SEQ ID NO: 741 - protein, 13 aa, Artificial Sequence
  Made in Lab - CRDH2 from anti-Fzd VH chain
GIINPSGGSTSYA

SEQ ID NO: 742 - protein, 13 aa, Artificial Sequence
  Made in Lab - CRDH2 from anti-Fzd VH chain
GMINPSGGRTTYA

SEQ ID NO: 743 - protein, 13 aa, Artificial Sequence
  Made in Lab - CRDH2 from anti-Fzd VH chain
GVINPSGGYTSYA

SEQ ID NO: 744 - protein, 13 aa, Artificial Sequence
  Made in Lab - CRDH2 from anti-Fzd VH chain
GIINPNDGNTRHA

SEQ ID NO: 745 - protein, 13 aa, Artificial Sequence
  Made in Lab - CRDH2 from anti-Fzd VH chain
GIINPNGGSTIYA

SEQ ID NO: 746 - protein, 13 aa, Artificial Sequence
  Made in Lab - CRDH2 from anti-Fzd VH chain
GGIIPIFGTANYA

SEQ ID NO: 747 - protein, 13 aa, Artificial Sequence
  Made in Lab - CRDH2 from anti-Fzd VH chain
GGIIPIFGTAHYP

SEQ ID NO: 748 - protein, 13 aa, Artificial Sequence
  Made in Lab - CRDH2 from anti-Fzd VH chain
GGIIPIFGTANYA

SEQ ID NO: 749 - protein, 13 aa, Artificial Sequence
  Made in Lab - CRDH2 from anti-Fzd VH chain
GIINPSGGSTSYA

SEQ ID NO: 750 - protein, 12 aa, Artificial Sequence
  Made in Lab - CRDH2 from anti-Fzd VH chain
SSINNSGDTYYA

SEQ ID NO: 751 - protein, 13 aa, Artificial Sequence
  Made in Lab - CRDH2 from anti-Fzd VH chain
GIINPSSGSTNYA

SEQ ID NO: 752 - protein, 13 aa, Artificial Sequence
  Made in Lab - CRDH2 from anti-Fzd VH chain
GGINPNSGGTNYA

SEQ ID NO: 753 - protein, 13 aa, Artificial Sequence
  Made in Lab - CRDH2 from anti-Fzd VH chain
GIINPDYGNTMYA

SEQ ID NO: 754 - protein, 13 aa, Artificial Sequence
  Made in Lab - CRDH2 from anti-Fzd VH chain
GIINPSGGSTSYA

SEQ ID NO: 755 - protein, 13 aa, Artificial Sequence
  Made in Lab - CRDH2 from anti-Fzd VH chain
GIINPSSGRTYHA

SEQ ID NO: 756 - protein, 13 aa, Artificial Sequence
  Made in Lab - CRDH2 from anti-Fzd VH chain
GIINPSGGSTYHA

SEQ ID NO: 757 - protein, 13 aa, Artificial Sequence
  Made in Lab - CRDH2 from anti-Fzd VH chain
GGIIPISGTASYA

SEQ ID NO: 758 - protein, 13 aa, Artificial Sequence
  Made in Lab - CRDH2 from anti-Fzd VH chain
GIINPSGGSTSYA

SEQ ID NO: 759 - protein, 13 aa, Artificial Sequence
  Made in Lab - CRDH2 from anti-Fzd VH chain
GGIIPMSGSPSYA

SEQ ID NO: 760 - protein, 13 aa, Artificial Sequence
  Made in Lab - CRDH2 from anti-Fzd VH chain
GIINPSGGSTSYA

SEQ ID NO: 761 - protein, 13 aa, Artificial Sequence
  Made in Lab - CRDH2 from anti-Fzd VH chain
GWINPNSGGTNYA

SEQ ID NO: 762 - protein, 13 aa, Artificial Sequence
  Made in Lab - CRDH2 from anti-Fzd VH chain
GIINPSGGSTRYA

SEQ ID NO: 763 - protein, 13 aa, Artificial Sequence
  Made in Lab - CRDH2 from anti-Fzd VH chain
GWINPNSGGTNLA

SEQ ID NO: 764 - protein, 13 aa, Artificial Sequence
  Made in Lab - CRDH2 from anti-Fzd VH chain
GWMNPNSGNTGSA

SEQ ID NO: 765 - protein, 13 aa, Artificial Sequence
  Made in Lab - CRDH2 from anti-Fzd VH chain
GIISPSGGTTAYA

SEQ ID NO: 766 - protein, 13 aa, Artificial Sequence
  Made in Lab - CRDH2 from anti-Fzd VH chain
GWISASNGNTNYA

SEQ ID NO: 767 - protein, 13 aa, Artificial Sequence
  Made in Lab - CRDH2 from anti-Fzd VH chain
GWISAYNGNTNYA

SEQ ID NO: 768 - protein, 13 aa, Artificial Sequence
  Made in Lab - CRDH2 from anti-Fzd VH chain
GWMNPNSGNTGYA

SEQ ID NO: 769 - protein, 13 aa, Artificial Sequence
  Made in Lab - CRDH2 from anti-Fzd VH chain
GWISAYNGNTNYA

SEQ ID NO: 770 - protein, 13 aa, Artificial Sequence
  Made in Lab - CRDH2 from anti-Fzd VH chain
GIINPGGGGTSYA

SEQ ID NO: 771 - protein, 13 aa, Artificial Sequence
  Made in Lab - CRDH2 from anti-Fzd VH chain
SAISGSGGSTYYA

SEQ ID NO: 772 - protein, 13 aa, Artificial Sequence
  Made in Lab - CRDH2 from anti-Fzd VH chain
SSISSSSSYIYYA

SEQ ID NO: 773 - protein, 13 aa, Artificial Sequence
  Made in Lab - CRDH2 from anti-Fzd VH chain
GWINPNSGNTGYA

SEQ ID NO: 774 - protein, 13 aa, Artificial Sequence
  Made in Lab - CRDH2 from anti-Fzd VH chain
GWISAYNGNTNYA

SEQ ID NO: 775 - protein, 13 aa, Artificial Sequence
  Made in Lab - CRDH2 from anti-Fzd VH chain
SAIGGSGANAYYA

SEQ ID NO: 776 - protein, 13 aa, Artificial Sequence
  Made in Lab - CRDH2 from anti-Fzd VH chain
GWMNPNSGNTGYA

SEQ ID NO: 777 - protein, 13 aa, Artificial Sequence
  Made in Lab - CRDH2 from anti-Fzd VH chain
GWMNPKSGNTGNA

SEQ ID NO: 778 - protein, 13 aa, Artificial Sequence
  Made in Lab - CRDH2 from anti-Fzd VH chain
GKINPTGGSTSYA

SEQ ID NO: 779 - protein, 13 aa, Artificial Sequence
  Made in Lab - CRDH2 from anti-Fzd VH chain
GIINPNGGNTSYA

SEQ ID NO: 780 - protein, 13 aa, Artificial Sequence
  Made in Lab - CRDH2 from anti-Fzd VH chain
SAIGGIGDSTYYA

SEQ ID NO: 781 - protein, 13 aa, Artificial Sequence
  Made in Lab - CRDH2 from anti-Fzd VH chain
SAIGGIGDSTYYA

SEQ ID NO: 782 - protein, 13 aa, Artificial Sequence
  Made in Lab - CRDH2 from anti-Fzd VH chain
GWMNPNTGNTGYA

SEQ ID NO: 783 - protein, 13 aa, Artificial Sequence
  Made in Lab - CRDH2 from anti-Fzd VH chain
GWMNPNSGNTVYA

SEQ ID NO: 784 - protein, 13 aa, Artificial Sequence
  Made in Lab - CRDH2 from anti-Fzd VH chain
GWMNPNSGNTGYA

SEQ ID NO: 785 - protein, 13 aa, Artificial Sequence
  Made in Lab - CRDH2 from anti-Fzd VH chain
GGIIPISGTAKYV

SEQ ID NO: 786 - protein, 13 aa, Artificial Sequence
  Made in Lab - CRDH2 from anti-Fzd VH chain
GGIIPSFGSAKYA

SEQ ID NO: 787 - protein, 13 aa, Artificial Sequence
  Made in Lab - CRDH2 from anti-Fzd VH chain
GWMNPNTGNTGYA

SEQ ID NO: 788 - protein, 13 aa, Artificial Sequence
  Made in Lab - CRDH2 from anti-Fzd VH chain
GIINPSGGSTSYA

SEQ ID NO: 789 - protein, 12 aa, Artificial Sequence
  Made in Lab - CRDH2 from anti-Fzd VH chain
ATIGSGALTNYA

SEQ ID NO: 790 - protein, 13 aa, Artificial Sequence
  Made in Lab - CRDH2 from anti-Fzd VH chain
GKINZTGGSTZYA

SEQ ID NO: 791 - protein, 13 aa, Artificial Sequence
  Made in Lab - CRDH2 from anti-Fzd VH chain
SAIDNSGHRTWYA

SEQ ID NO: 792 - protein, 13 aa, Artificial Sequence
  Made in Lab - CRDH2 from anti-Fzd VH chain
GIINPNGGSTSYA

SEQ ID NO: 793 - protein, 13 aa, Artificial Sequence
  Made in Lab - CRDH2 from anti-Fzd VH chain
GWISGYNGNTNYA

SEQ ID NO: 794 - protein, 13 aa, Artificial Sequence
  Made in Lab - CRDH2 from anti-Fzd VH chain
GIINPSGGSTSYA

SEQ ID NO: 795 - protein, 13 aa, Artificial Sequence
  Made in Lab - CRDH2 from anti-Fzd VH chain
GKINPTGGSTZYA

SEQ ID NO: 796 - protein, 13 aa, Artificial Sequence
  Made in Lab - CRDH2 from anti-Fzd VH chain
GGIIPMSGSPSYA

SEQ ID NO: 797 - protein, 13 aa, Artificial Sequence
  Made in Lab - CRDH2 from anti-Fzd VH chain
GWMNPNSGNTGYA

SEQ ID NO: 798 - protein, 13 aa, Artificial Sequence
  Made in Lab - CRDH2 from anti-Fzd VH chain
GWMNPDSGDTGYA

SEQ ID NO: 799 - protein, 13 aa, Artificial Sequence
  Made in Lab - CRDH2 from anti-Fzd VH chain
GWINPNSGGTNYA

SEQ ID NO: 800 - protein, 13 aa, Artificial Sequence
  Made in Lab - CRDH2 from anti-Fzd VH chain
GWMSPASGNTGYA

SEQ ID NO: 801 - protein, 13 aa, Artificial Sequence
  Made in Lab - CRDH2 from anti-Fzd VH chain
GWMNPNSGNTGYA

SEQ ID NO: 802 - protein, 13 aa, Artificial Sequence
  Made in Lab - CRDH2 from anti-Fzd VH chain
GWISGYNGNTNYA

SEQ ID NO: 803 - protein, 13 aa, Artificial Sequence
  Made in Lab - CRDH2 from anti-Fzd VH chain
GWINPNGGNTSYA

SEQ ID NO: 804 - protein, 13 aa, Artificial Sequence
  Made in Lab - CRDH2 from anti-Fzd VH chain
GWMNPNSGNTGYA

SEQ ID NO: 805 - protein, 13 aa, Artificial Sequence
  Made in Lab - CRDH2 from anti-Fzd VH chain
GKINPTGGSTSYA

SEQ ID NO: 806 - protein, 13 aa, Artificial Sequence
  Made in Lab - CRDH2 from anti-Fzd VH chain
GWISAYNGNTNYA

SEQ ID NO: 807 - protein, 13 aa, Artificial Sequence
  Made in Lab - CRDH2 from anti-Fzd VH chain
GWMNPDSGDTGYA

SEQ ID NO: 808 - protein, 13 aa, Artificial Sequence
  Made in Lab - CRDH2 from anti-Fzd VH chain
SAISFSGGSTYYA

SEQ ID NO: 809 - protein, 13 aa, Artificial Sequence
  Made in Lab - CRDH2 from anti-Fzd VH chain
GWINPKSGGTTYA

SEQ ID NO: 810 - protein, 13 aa, Artificial Sequence
  Made in Lab - CRDH2 from anti-Fzd VH chain
SYITGSGSTRYYA

SEQ ID NO: 811 - protein, 13 aa, Artificial Sequence
  Made in Lab - CRDH2 from anti-Fzd VH chain
GWMNPKSGNTGNA

SEQ ID NO: 812 - protein, 13 aa, Artificial Sequence
  Made in Lab - CRDH2 from anti-Fzd VH chain
SAIGGIGDSTYYA

SEQ ID NO: 813 - protein, 13 aa, Artificial Sequence
  Made in Lab - CRDH2 from anti-Fzd VH chain
GWMNPSSGNTGYA

SEQ ID NO: 814 - protein, 13 aa, Artificial Sequence
  Made in Lab - CRDH2 from anti-Fzd VH chain
STISGGGVSTYYA

SEQ ID NO: 815 - protein, 13 aa, Artificial Sequence
  Made in Lab - CRDH2 from anti-Fzd VH chain
GWMNPNTGNTGYA

SEQ ID NO: 816 - protein, 13 aa, Artificial Sequence
  Made in Lab - CRDH2 from anti-Fzd VH chain
GIINPSGGSTRYA

SEQ ID NO: 817 - protein, 13 aa, Artificial Sequence
  Made in Lab - CRDH2 from anti-Fzd VH chain
GIINPSGGSTSYA

SEQ ID NO: 818 - protein, 13 aa, Artificial Sequence
  Made in Lab - CRDH2 from anti-Fzd VH chain
GWMNPNSGNTAYA

SEQ ID NO: 819 - protein, 13 aa, Artificial Sequence
  Made in Lab - CRDH2 from anti-Fzd VH chain
GWMNPNSGKTGYA

SEQ ID NO: 820 - protein, 13 aa, Artificial Sequence
  Made in Lab - CRDH2 from anti-Fzd VH chain
SAISRGGDNTYYA

SEQ ID NO: 821 - protein, 13 aa, Artificial Sequence
  Made in Lab - CRDH2 from anti-Fzd VH chain
GWMNPTNGNTGYA

SEQ ID NO: 822 - protein, 13 aa, Artificial Sequence
  Made in Lab - CRDH2 from anti-Fzd VH chain
SSISGSGGYTYYA

SEQ ID NO: 823 - protein, 13 aa, Artificial Sequence
  Made in Lab - CRDH2 from anti-Fzd VH chain
GWMNPNSGNTGYA

SEQ ID NO: 824 - protein, 13 aa, Artificial Sequence
  Made in Lab - CRDH2 from anti-Fzd VH chain
GWISAYNGNTNYA

SEQ ID NO: 825 - protein, 13 aa, Artificial Sequence
  Made in Lab - CRDH2 from anti-Fzd VH chain
SYISSGSSYIYYA

SEQ ID NO: 826 - protein, 13 aa, Artificial Sequence
  Made in Lab - CRDH2 from anti-Fzd VH chain
GWMNPNSGNTGYA

SEQ ID NO: 827 - protein, 13 aa, Artificial Sequence
  Made in Lab - CRDH2 from anti-Fzd VH chain
GIINPSGGSTIYA

SEQ ID NO: 828 - protein, 13 aa, Artificial Sequence
  Made in Lab - CRDH2 from anti-Fzd VH chain
GVINPSGGGRTYA

SEQ ID NO: 829 - protein, 13 aa, Artificial Sequence
  Made in Lab - CRDH2 from anti-Fzd VH chain
GWINPASGGTKYA

SEQ ID NO: 830 - protein, 13 aa, Artificial Sequence
  Made in Lab - CRDH2 from anti-Fzd VH chain
GWMNPNSGNTGYA

SEQ ID NO: 831 - protein, 13 aa, Artificial Sequence
  Made in Lab - CRDH2 from anti-Fzd VH chain
SAISTGGGTTYYA

SEQ ID NO: 832 - protein, 13 aa, Artificial Sequence
  Made in Lab - CRDH2 from anti-Fzd VH chain
GWINPNSGGTNYA

SEQ ID NO: 833 - protein, 13 aa, Artificial Sequence
  Made in Lab - CRDH2 from anti-Fzd VH chain
GRINPNSGNTGYA

SEQ ID NO: 834 - protein, 13 aa, Artificial Sequence
  Made in Lab - CRDH2 from anti-Fzd VH chain
GWISPHSGRTRYA

SEQ ID NO: 835 - protein, 13 aa, Artificial Sequence
  Made in Lab - CRDH2 from anti-Fzd VH chain
GWMNPNSGNTGYA

SEQ ID NO: 836 - protein, 13 aa, Artificial Sequence
  Made in Lab - CRDH2 from anti-Fzd VH chain
GWMNPNSGNTGYG

SEQ ID NO: 837 - protein, 13 aa, Artificial Sequence
  Made in Lab - CRDH2 from anti-Fzd VH chain
GWMNPSSGNTGYA

SEQ ID NO: 838 - protein, 13 aa, Artificial Sequence
  Made in Lab - CRDH2 from anti-Fzd VH chain
GWMNPNSGNTGYA

SEQ ID NO: 839 - protein, 13 aa, Artificial Sequence
  Made in Lab - CRDH2 from anti-Fzd VH chain
GRISGYNGNTNYA

SEQ ID NO: 840 - protein, 13 aa, Artificial Sequence
  Made in Lab - CRDH2 from anti-Fzd VH chain
GWMNPNSGNAGYA

SEQ ID NO: 841 - protein, 13 aa, Artificial Sequence
  Made in Lab - CRDH2 from anti-Fzd VH chain
GWMNPNSGNTGLV

SEQ ID NO: 842 - protein, 13 aa, Artificial Sequence
  Made in Lab - CRDH2 from anti-Fzd VH chain
GWMNPNSGNTGSA

SEQ ID NO: 843 - protein, 13 aa, Artificial Sequence
  Made in Lab - CRDH2 from anti-Fzd VH chain
GIVDPMTGSTSYA

SEQ ID NO: 844 - protein, 13 aa, Artificial Sequence
  Made in Lab - CRDH2 from anti-Fzd VH chain
SSISSSGGSTYYA

SEQ ID NO: 845 - protein, 13 aa, Artificial Sequence
  Made in Lab - CRDH2 from anti-Fzd VH chain
SAISGSGGSTYYA

SEQ ID NO: 846 - protein, 13 aa, Artificial Sequence
  Made in Lab - CRDH2 from anti-Fzd VH chain
SAISGSGGSTYYA

SEQ ID NO: 847 - protein, 13 aa, Artificial Sequence
  Made in Lab - CRDH2 from anti-Fzd VH chain
GWISAYSGNTKYA

SEQ ID NO: 848 - protein, 13 aa, Artificial Sequence
  Made in Lab - CRDH2 from anti-Fzd VH chain
GWINSNNGETDFA

SEQ ID NO: 849 - protein, 13 aa, Artificial Sequence
  Made in Lab - CRDH2 from anti-Fzd VH chain
GWMNPNSGYTGYA

SEQ ID NO: 850 - protein, 13 aa, Artificial Sequence
  Made in Lab - CRDH2 from anti-Fzd VH chain
GWINPNTGGTNFA

SEQ ID NO: 851 - protein, 13 aa, Artificial Sequence
  Made in Lab - CRDH2 from anti-Fzd VH chain
GWISAYNGNTKYA

SEQ ID NO: 852 - protein, 13 aa, Artificial Sequence
  Made in Lab - CRDH2 from anti-Fzd VH chain
GWMNRNSGNTGYA

SEQ ID NO: 853 - protein, 13 aa, Artificial Sequence
  Made in Lab - CRDH2 from anti-Fzd VH chain
GSINTGGGGTTYA

SEQ ID NO: 854 - protein, 13 aa, Artificial Sequence
  Made in Lab - CRDH2 from anti-Fzd VH chain
AVISHDGRKKYYA

SEQ ID NO: 855 - protein, 13 aa, Artificial Sequence
  Made in Lab - CRDH2 from anti-Fzd VH chain
GWINPNSGGTNYA

SEQ ID NO: 856 - protein, 13 aa, Artificial Sequence
  Made in Lab - CRDH2 from anti-Fzd VH chain
GWINPNSGNTGNA

SEQ ID NO: 857 - protein, 13 aa, Artificial Sequence
  Made in Lab - CRDH2 from anti-Fzd VH chain
GWMNPNSGNTGYA

SEQ ID NO: 858 - protein, 13 aa, Artificial Sequence
  Made in Lab - CRDH2 from anti-Fzd VH chain
SVISGSGGSTYYA

SEQ ID NO: 859 - protein, 13 aa, Artificial Sequence
  Made in Lab - CRDH2 from anti-Fzd VH chain
GWMNPNSGNTGYA

SEQ ID NO: 860 - protein, 13 aa, Artificial Sequence
  Made in Lab - CRDH2 from anti-Fzd VH chain
GIINPSGGSTRYA

SEQ ID NO: 861 - protein, 13 aa, Artificial Sequence
  Made in Lab - CRDH2 from anti-Fzd VH chain
GWMNPNSGNTGYA

SEQ ID NO: 862 - protein, 13 aa, Artificial Sequence
  Made in Lab - CRDH2 from anti-Fzd VH chain
GRMDPNSGKTDSA

SEQ ID NO: 863 - protein, 13 aa, Artificial Sequence
  Made in Lab - CRDH2 from anti-Fzd VH chain
GIINPSNGRTSYA

SEQ ID NO: 864 - protein, 13 aa, Artificial Sequence
  Made in Lab - CRDH2 from anti-Fzd VH chain
GWMNPNSGNTGYA

SEQ ID NO: 865 - protein, 13 aa, Artificial Sequence
  Made in Lab - CRDH2 from anti-Fzd VH chain
SSISSSSSYIYYA

SEQ ID NO: 866 - protein, 12 aa, Artificial Sequence
  Made in Lab - CRDH2 from anti-Fzd VH chain
SAIGTGGGTYYA

SEQ ID NO: 867 - protein, 13 aa, Artificial Sequence
  Made in Lab - CRDH2 from anti-Fzd VH chain
SAISGNSVSTYYA

SEQ ID NO: 868 - protein, 13 aa, Artificial Sequence
  Made in Lab - CRDH2 from anti-Fzd VH chain
GWMNPNSGNTZYA

SEQ ID NO: 869 - protein, 13 aa, Artificial Sequence
  Made in Lab - CRDH2 from anti-Fzd VH chain
SAISGTGRSTYYA

SEQ ID NO: 870 - protein, 13 aa, Artificial Sequence
  Made in Lab - CRDH2 from anti-Fzd VH chain
SRINSDGSRTNYA

SEQ ID NO: 871 - protein, 13 aa, Artificial Sequence
  Made in Lab - CRDH2 from anti-Fzd VH chain
SAISGSSGNTYYA

SEQ ID NO: 872 - protein, 13 aa, Artificial Sequence
  Made in Lab - CRDH2 from anti-Fzd VH chain
SAISGSGGSTYYA

SEQ ID NO: 873 - protein, 13 aa, Artificial Sequence
  Made in Lab - CRDH2 from anti-Fzd VH chain
GWMNPNSGNTGYA

SEQ ID NO: 874 - protein, 13 aa, Artificial Sequence
  Made in Lab - CRDH2 from anti-Fzd VH chain
GWMSPNSGNTGYA

SEQ ID NO: 875 - protein, 13 aa, Artificial Sequence
  Made in Lab - CRDH2 from anti-Fzd VH chain
GGINPSSGSTTYA

SEQ ID NO: 876 - protein, 13 aa, Artificial Sequence
  Made in Lab - CRDH2 from anti-Fzd VH chain
GWMNPNSGNTGYA

SEQ ID NO: 877 - protein, 13 aa, Artificial Sequence
  Made in Lab - CRDH2 from anti-Fzd VH chain
GIINPSGGSTSYA

SEQ ID NO: 878 - protein, 13 aa, Artificial Sequence
  Made in Lab - CRDH2 from anti-Fzd VH chain
GWMNPNSGNTGYA

SEQ ID NO: 879 - protein, 13 aa, Artificial Sequence
  Made in Lab - CRDH2 from anti-Fzd VH chain
SYISGNSGYTNYA

SEQ ID NO: 880 - protein, 13 aa, Artificial Sequence
  Made in Lab - CRDH2 from anti-Fzd VH chain
GIINPSGGSTSYA

SEQ ID NO: 881 - protein, 13 aa, Artificial Sequence
  Made in Lab - CRDH2 from anti-Fzd VH chain
GRMNPNSGNTVYA

SEQ ID NO: 882 - protein, 13 aa, Artificial Sequence
  Made in Lab - CRDH2 from anti-Fzd VH chain
AVISYDGSNKYYA

SEQ ID NO: 883 - protein, 13 aa, Artificial Sequence
  Made in Lab - CRDH2 from anti-Fzd VH chain
SFISGSGGSTDYA

SEQ ID NO: 884 - protein, 13 aa, Artificial Sequence
  Made in Lab - CRDH2 from anti-Fzd VH chain
AVISYDGSNKYYA

SEQ ID NO: 885 - protein, 13 aa, Artificial Sequence
  Made in Lab - CRDH2 from anti-Fzd VH chain
GRINPANGNASYA

SEQ ID NO: 886 - protein, 13 aa, Artificial Sequence
  Made in Lab - CRDH2 from anti-Fzd VH chain
GRINPDSGYTNYA

SEQ ID NO: 887 - protein, 12 aa, Artificial Sequence
  Made in Lab - CRDH2 from anti-Fzd VH chain
SAIGTGGGTYYA

SEQ ID NO: 888 - protein, 13 aa, Artificial Sequence
  Made in Lab - CRDH2 from anti-Fzd VH chain
GIINPRRGSTRYA

SEQ ID NO: 889 - protein, 13 aa, Artificial Sequence
  Made in Lab - CRDH2 from anti-Fzd VH chain
SAISGSGGSTYYA

SEQ ID NO: 890 - protein, 13 aa, Artificial Sequence
  Made in Lab - CRDH2 from anti-Fzd VH chain
TVISSDGSTKSYA

SEQ ID NO: 891 - protein, 13 aa, Artificial Sequence
  Made in Lab - CRDH2 from anti-Fzd VH chain
GWMNPNSGNTGYA

SEQ ID NO: 892 - protein, 13 aa, Artificial Sequence
  Made in Lab - CRDH2 from anti-Fzd VH chain
GWMNPSSGNTGYA

SEQ ID NO: 893 - protein, 13 aa, Artificial Sequence
  Made in Lab - CRDH2 from anti-Fzd VH chain
GWINPNSGNTGYA

SEQ ID NO: 894 - protein, 13 aa, Artificial Sequence
  Made in Lab - CRDH2 from anti-Fzd VH chain
GGIIPMSGTSNYA

SEQ ID NO: 895 - protein, 13 aa, Artificial Sequence
  Made in Lab - CRDH2 from anti-Fzd VH chain
GWINPKNGGTHYA

SEQ ID NO: 896 - protein, 13 aa, Artificial Sequence
  Made in Lab - CRDH2 from anti-Fzd VH chain
ASISSSSSHIYYA

SEQ ID NO: 897 - protein, 13 aa, Artificial Sequence
  Made in Lab - CRDH2 from anti-Fzd VH chain
TVISSDGSTZSYA

SEQ ID NO: 898 - protein, 13 aa, Artificial Sequence
  Made in Lab - CRDH2 from anti-Fzd VH chain
SSISSSSSYIYYA

SEQ ID NO: 899 - protein, 13 aa, Artificial Sequence
  Made in Lab - CRDH2 from anti-Fzd VH chain
SAISGSGGSTYYA

SEQ ID NO: 900 - protein, 13 aa, Artificial Sequence
  Made in Lab - CRDH2 from anti-Fzd VH chain
GWINPNSGGTNYA

SEQ ID NO: 901 - protein, 13 aa, Artificial Sequence
  Made in Lab - CRDH2 from anti-Fzd VH chain
GLITPSGDYATYA

SEQ ID NO: 902 - protein, 13 aa, Artificial Sequence
  Made in Lab - CRDH2 from anti-Fzd VH chain
GGIIPVLGTTKYA

SEQ ID NO: 903 - protein, 13 aa, Artificial Sequence
  Made in Lab - CRDH2 from anti-Fzd VH chain
GIINPNGGGTRYA

SEQ ID NO: 904 - protein, 13 aa, Artificial Sequence
  Made in Lab - CRDH2 from anti-Fzd VH chain
GWMNPNSGNTGFA

SEQ ID NO: 905 - protein, 13 aa, Artificial Sequence
  Made in Lab - CRDH2 from anti-Fzd VH chain
GKINPRDGSTTYA

SEQ ID NO: 906 - protein, 13 aa, Artificial Sequence
  Made in Lab - CRDH2 from anti-Fzd VH chain
STISGNGGRTYYA

SEQ ID NO: 907 - protein, 13 aa, Artificial Sequence
  Made in Lab - CRDH2 from anti-Fzd VH chain
GWMNPNTGNTGYA

SEQ ID NO: 908 - protein, 13 aa, Artificial Sequence
  Made in Lab - CRDH2 from anti-Fzd VH chain
SAISGSGGSTYYA

SEQ ID NO: 909 - protein, 13 aa, Artificial Sequence
  Made in Lab - CRDH2 from anti-Fzd VH chain
SAISRSGATTYYS

SEQ ID NO: 910 - protein, 13 aa, Artificial Sequence
  Made in Lab - CRDH2 from anti-Fzd VH chain
GWINPKSGGTNYA

SEQ ID NO: 911 - protein, 13 aa, Artificial Sequence
  Made in Lab - CRDH2 from anti-Fzd VH chain
GWMNPNSGNTGYA

SEQ ID NO: 912 - protein, 13 aa, Artificial Sequence
  Made in Lab - CRDH2 from anti-Fzd VH chain
GWMNPHSGNTGYA

SEQ ID NO: 913 - protein, 13 aa, Artificial Sequence
  Made in Lab - CRDH2 from anti-Fzd VH chain
GMINPSGQSTTYA

SEQ ID NO: 914 - protein, 13 aa, Artificial Sequence
  Made in Lab - CRDH2 from anti-Fzd VH chain
GIINPSGGTTNYA

SEQ ID NO: 915 - protein, 13 aa, Artificial Sequence
  Made in Lab - CRDH2 from anti-Fzd VH chain
GWISAYNGKTNYA

SEQ ID NO: 916 - protein, 13 aa, Artificial Sequence
  Made in Lab - CRDH2 from anti-Fzd VH chain
GWMNPNSGNTGYA

SEQ ID NO: 917 - protein, 13 aa, Artificial Sequence
  Made in Lab - CRDH2 from anti-Fzd VH chain
AAVSRSGGSTFYA

SEQ ID NO: 918 - protein, 13 aa, Artificial Sequence
  Made in Lab - CRDH2 from anti-Fzd VH chain
GVINPSGGSTSYA

SEQ ID NO: 919 - protein, 13 aa, Artificial Sequence
  Made in Lab - CRDH2 from anti-Fzd VH chain
SGINWNGGSTGYA

SEQ ID NO: 920 - protein, 13 aa, Artificial Sequence
  Made in Lab - CRDH2 from anti-Fzd VH chain
GWISGYNGNTNYA

SEQ ID NO: 921 - protein, 13 aa, Artificial Sequence
  Made in Lab - CRDH2 from anti-Fzd VH chain
GIINPDTGSATYA

SEQ ID NO: 922 - protein, 13 aa, Artificial Sequence
  Made in Lab - CRDH2 from anti-Fzd VH chain
GWMNPNSGNTGYV

SEQ ID NO: 923 - protein, 13 aa, Artificial Sequence
  Made in Lab - CRDH2 from anti-Fzd VH chain
GWISAYSGNTNYA

SEQ ID NO: 924 - protein, 13 aa, Artificial Sequence
  Made in Lab - CRDH2 from anti-Fzd VH chain
GMINPSGGSTSYA

SEQ ID NO: 925 - protein, 13 aa, Artificial Sequence
  Made in Lab - CRDH2 from anti-Fzd VH chain
SGISSNGGSTYYA

SEQ ID NO: 926 - protein, 13 aa, Artificial Sequence
  Made in Lab - CRDH2 from anti-Fzd VH chain
GWMNPNSGNTGYA

SEQ ID NO: 927 - protein, 13 aa, Artificial Sequence
  Made in Lab - CRDH2 from anti-Fzd VH chain
GWMNPNSGNTGYA

SEQ ID NO: 928 - protein, 13 aa, Artificial Sequence
  Made in Lab - CRDH2 from anti-Fzd VH chain
GMINPSGGSTSYA

SEQ ID NO: 929 - protein, 13 aa, Artificial Sequence
  Made in Lab - CRDH2 from anti-Fzd VH chain
GWMNPNSGNTGYA

SEQ ID NO: 930 - protein, 13 aa, Artificial Sequence
  Made in Lab - CRDH2 from anti-Fzd VH chain
SAISGGGGSTYYA

SEQ ID NO: 931 - protein, 13 aa, Artificial Sequence
  Made in Lab - CRDH2 from anti-Fzd VH chain
GLINPSGGSTRYA

SEQ ID NO: 932 - protein, 13 aa, Artificial Sequence
  Made in Lab - CRDH2 from anti-Fzd VH chain
GIINSRRGSTRYA

SEQ ID NO: 933 - protein, 13 aa, Artificial Sequence
  Made in Lab - CRDH2 from anti-Fzd VH chain
GVINPSGGSTSYA

SEQ ID NO: 934 - protein, 13 aa, Artificial Sequence
  Made in Lab - CRDH2 from anti-Fzd VH chain
SAISASGGGTYYA

SEQ ID NO: 935 - protein, 13 aa, Artificial Sequence
  Made in Lab - CRDH2 from anti-Fzd VH chain
GRINTNSGDTNYA

SEQ ID NO: 936 - protein, 13 aa, Artificial Sequence
  Made in Lab - CRDH2 from anti-Fzd VH chain
SAISGTTGRTYYA

SEQ ID NO: 937 - protein, 13 aa, Artificial Sequence
  Made in Lab - CRDH2 from anti-Fzd VH chain
AAIWNDGTNKYYA

SEQ ID NO: 938 - protein, 13 aa, Artificial Sequence
  Made in Lab - CRDH2 from anti-Fzd VH chain
GTINPRRGSTKYA

SEQ ID NO: 939 - protein, 13 aa, Artificial Sequence
  Made in Lab - CRDH2 from anti-Fzd VH chain
GWINPNSGNRGYA

SEQ ID NO: 940 - protein, 13 aa, Artificial Sequence
  Made in Lab - CRDH2 from anti-Fzd VH chain
GMINPRGGGTGYA

SEQ ID NO: 941 - protein, 13 aa, Artificial Sequence
  Made in Lab - CRDH2 from anti-Fzd VH chain
GWMNPSGGNTGYA

SEQ ID NO: 942 - protein, 13 aa, Artificial Sequence
  Made in Lab - CRDH2 from anti-Fzd VH chain
GVINPSGGSTIYA

SEQ ID NO: 943 - protein, 13 aa, Artificial Sequence
  Made in Lab - CRDH2 from anti-Fzd VH chain
GRIIPNTGDTNYA

SEQ ID NO: 944 - protein, 13 aa, Artificial Sequence
  Made in Lab - CRDH2 from anti-Fzd VH chain
GIINPSGGTTSYA

SEQ ID NO: 945 - protein, 13 aa, Artificial Sequence
  Made in Lab - CRDH2 from anti-Fzd VH chain
GWMQGDSGNTGYA

SEQ ID NO: 946 - protein, 13 aa, Artificial Sequence
  Made in Lab - CRDH2 from anti-Fzd VH chain
GWMNPNSGNTGYA

SEQ ID NO: 947 - protein, 13 aa, Artificial Sequence
  Made in Lab - CRDH2 from anti-Fzd VH chain
GWMNPNSGNTGYA

SEQ ID NO: 948 - protein, 13 aa, Artificial Sequence
  Made in Lab - CRDH2 from anti-Fzd VH chain
GWZNPNGGNTZYA

SEQ ID NO: 949 - protein, 13 aa, Artificial Sequence
  Made in Lab - CRDH2 from anti-Fzd VH chain
GWINPNSGNTGYA

SEQ ID NO: 950 - protein, 13 aa, Artificial Sequence
  Made in Lab - CRDH2 from anti-Fzd VH chain
GWMNPNSGNTAYA

SEQ ID NO: 951 - protein, 13 aa, Artificial Sequence
  Made in Lab - CRDH2 from anti-Fzd VH chain
GWINPNSGGTNYA

SEQ ID NO: 952 - protein, 13 aa, Artificial Sequence
  Made in Lab - CRDH2 from anti-Fzd VH chain
GWINPYSGGTSYA

SEQ ID NO: 953 - protein, 13 aa, Artificial Sequence
  Made in Lab - CRDH2 from anti-Fzd VH chain
SSISSSSSYIYYA

SEQ ID NO: 954 - protein, 13 aa, Artificial Sequence
  Made in Lab - CRDH2 from anti-Fzd VH chain
GRIIPNTGDTSYA

SEQ ID NO: 955 - protein, 13 aa, Artificial Sequence
  Made in Lab - CRDH2 from anti-Fzd VH chain
SSISSGSGYIYYA

SEQ ID NO: 956 - protein, 13 aa, Artificial Sequence
  Made in Lab - CRDH2 from anti-Fzd VH chain
SAISGSGGSTYYA

SEQ ID NO: 957 - protein, 13 aa, Artificial Sequence
  Made in Lab - CRDH2 from anti-Fzd VH chain
GWMNPNSGNTGYA

SEQ ID NO: 958 - protein, 13 aa, Artificial Sequence
  Made in Lab - CRDH2 from anti-Fzd VH chain
GWINPNSGGTNYA

SEQ ID NO: 959 - protein, 13 aa, Artificial Sequence
  Made in Lab - CRDH2 from anti-Fzd VH chain
ASISSSSSYIYYA

SEQ ID NO: 960 - protein, 13 aa, Artificial Sequence
  Made in Lab - CRDH2 from anti-Fzd VH chain
GWMNPNSGNTGYA

SEQ ID NO: 961 - protein, 13 aa, Artificial Sequence
  Made in Lab - CRDH2 from anti-Fzd VH chain
GWMNPNSGNTGYA

SEQ ID NO: 962 - protein, 13 aa, Artificial Sequence
  Made in Lab - CRDH2 from anti-Fzd VH chain
GVINPSGGSTVYA

SEQ ID NO: 963 - protein, 13 aa, Artificial Sequence
  Made in Lab - CRDH2 from anti-Fzd VH chain
SGITGSGGATYYA

SEQ ID NO: 964 - protein, 13 aa, Artificial Sequence
  Made in Lab - CRDH2 from anti-Fzd VH chain
SAISGSGGSTYYA

SEQ ID NO: 965 - protein, 13 aa, Artificial Sequence
  Made in Lab - CRDH2 from anti-Fzd VH chain
GWMNPNSGNTGYA

SEQ ID NO: 966 - protein, 13 aa, Artificial Sequence
  Made in Lab - CRDH2 from anti-Fzd VH chain
SAISGSGGSTYYA

SEQ ID NO: 967 - protein, 13 aa, Artificial Sequence
  Made in Lab - CRDH2 from anti-Fzd VH chain
GWINTKTGAANYA

SEQ ID NO: 968 - protein, 13 aa, Artificial Sequence
  Made in Lab - CRDH2 from anti-Fzd VH chain
GRINPNSGATNYA

SEQ ID NO: 969 - protein, 13 aa, Artificial Sequence
  Made in Lab - CRDH2 from anti-Fzd VH chain
SSISGRSSFIYYA

SEQ ID NO: 970 - protein, 13 aa, Artificial Sequence
  Made in Lab - CRDH2 from anti-Fzd VH chain
SAVDGAGTNTYYA

SEQ ID NO: 971 - protein, 13 aa, Artificial Sequence
  Made in Lab - CRDH2 from anti-Fzd VH chain
GWMNPSNGDTGYA

SEQ ID NO: 972 - protein, 13 aa, Artificial Sequence
  Made in Lab - CRDH2 from anti-Fzd VH chain
GVINPSGGRTTYA

SEQ ID NO: 973 - protein, 13 aa, Artificial Sequence
  Made in Lab - CRDH2 from anti-Fzd VH chain
GWMNPNSGDTGYA

SEQ ID NO: 974 - protein, 13 aa, Artificial Sequence
  Made in Lab - CRDH2 from anti-Fzd VH chain
GWMNPNSGNTGYA

SEQ ID NO: 975 - protein, 13 aa, Artificial Sequence
  Made in Lab - CRDH2 from anti-Fzd VH chain
GVINPSGGSTTYA

SEQ ID NO: 976 - protein, 13 aa, Artificial Sequence
  Made in Lab - CRDH2 from anti-Fzd VH chain
GWMNPNSGNTGYA

SEQ ID NO: 977 - protein, 13 aa, Artificial Sequence
  Made in Lab - CRDH2 from anti-Fzd VH chain
GWINPKSGGTRYA

SEQ ID NO: 978 - protein, 13 aa, Artificial Sequence
  Made in Lab - CRDH2 from anti-Fzd VH chain
SAISGTGRYTYYA

SEQ ID NO: 979 - protein, 13 aa, Artificial Sequence
  Made in Lab - CRDH2 from anti-Fzd VH chain
GWINPNSGGAHYA

SEQ ID NO: 980 - protein, 13 aa, Artificial Sequence
  Made in Lab - CRDH2 from anti-Fzd VH chain
GWMNPNSGNTGYA

SEQ ID NO: 981 - protein, 13 aa, Artificial Sequence
  Made in Lab - CRDH2 from anti-Fzd VH chain
SGISGSGGRTYYA

SEQ ID NO: 982 - protein, 13 aa, Artificial Sequence
  Made in Lab - CRDH2 from anti-Fzd VH chain
GWMNPKSGNTGYA

SEQ ID NO: 983 - protein, 13 aa, Artificial Sequence
  Made in Lab - CRDH2 from anti-Fzd VH chain
GWMNPNSANTGYA

SEQ ID NO: 984 - protein, 13 aa, Artificial Sequence
  Made in Lab - CRDH2 from anti-Fzd VH chain
GWMNPNTGNTGYA

SEQ ID NO: 985 - protein, 13 aa, Artificial Sequence
  Made in Lab - CRDH2 from anti-Fzd VH chain
GRIIPNTGDTNYA

SEQ ID NO: 986 - protein, 13 aa, Artificial Sequence
  Made in Lab - CRDH2 from anti-Fzd VH chain
GWINPNSGNTGYA

SEQ ID NO: 987 - protein, 13 aa, Artificial Sequence
  Made in Lab - CRDH2 from anti-Fzd VH chain
GVIIPSGGSTLYA

SEQ ID NO: 988 - protein, 13 aa, Artificial Sequence
  Made in Lab - CRDH2 from anti-Fzd VH chain
GVINPSGGATRFA

SEQ ID NO: 989 - protein, 13 aa, Artificial Sequence
  Made in Lab - CRDH2 from anti-Fzd VH chain
GWMNPHNGDTGYA

SEQ ID NO: 990 - protein, 13 aa, Artificial Sequence
  Made in Lab - CRDH2 from anti-Fzd VH chain
SGIRGSGGATYYA

SEQ ID NO: 991 - protein, 13 aa, Artificial Sequence
  Made in Lab - CRDH2 from anti-Fzd VH chain
AVISYDGSNKYYA

SEQ ID NO: 992 - protein, 13 aa, Artificial Sequence
  Made in Lab - CRDH2 from anti-Fzd VH chain
GWINSNSGGTNYA

SEQ ID NO: 993 - protein, 13 aa, Artificial Sequence
  Made in Lab - CRDH2 from anti-Fzd VH chain
GWMNPNTGYTGYA

SEQ ID NO: 994 - protein, 13 aa, Artificial Sequence
  Made in Lab - CRDH2 from anti-Fzd VH chain
GRINPNSGATNYA

SEQ ID NO: 995 - protein, 13 aa, Artificial Sequence
  Made in Lab - CRDH2 from anti-Fzd VH chain
GWMNPNSGNTGYA

SEQ ID NO: 996 - protein, 13 aa, Artificial Sequence
  Made in Lab - CRDH2 from anti-Fzd VH chain
GWVZAFNGDTNYA

SEQ ID NO: 997 - protein, 13 aa, Artificial Sequence
  Made in Lab - CRDH2 from anti-Fzd VH chain
GWMNPNSGNTGYA

SEQ ID NO: 998 - protein, 13 aa, Artificial Sequence
  Made in Lab - CRDH2 from anti-Fzd VH chain
GRIIPNTGDTNYA

SEQ ID NO: 999 - protein, 13 aa, Artificial Sequence
  Made in Lab - CRDH2 from anti-Fzd VH chain
GWMNPNSGNTGYA

SEQ ID NO: 1000 - protein, 13 aa, Artificial Sequence
  Made in Lab - CRDH2 from anti-Fzd VH chain
GWMNPSSGNTGYA

SEQ ID NO: 1001 - protein, 13 aa, Artificial Sequence
  Made in Lab - CRDH2 from anti-Fzd VH chain
GWMNPNSGNTGYA

SEQ ID NO: 1002 - protein, 13 aa, Artificial Sequence
  Made in Lab - CRDH2 from anti-Fzd VH chain
GWMNPHSANTGFA

SEQ ID NO: 1003 - protein, 13 aa, Artificial Sequence
  Made in Lab - CRDH2 from anti-Fzd VH chain
GWINPNSGNTGFA

SEQ ID NO: 1004 - protein, 13 aa, Artificial Sequence
  Made in Lab - CRDH2 from anti-Fzd VH chain
GWVSAFNGDTNYA

SEQ ID NO: 1005 - protein, 13 aa, Artificial Sequence
  Made in Lab - CRDH2 from anti-Fzd VH chain
GRIIPILGIANYA

SEQ ID NO: 1006 - protein, 13 aa, Artificial Sequence
  Made in Lab - CRDH2 from anti-Fzd VH chain
GMIIPRHGGTAYA

SEQ ID NO: 1007 - protein, 13 aa, Artificial Sequence
  Made in Lab - CRDH2 from anti-Fzd VH chain
  misc_feature (12)..(12): Xaa can be any naturally occurring amino acid
AVISYDGSNKYXA

SEQ ID NO: 1008 - protein, 13 aa, Artificial Sequence
  Made in Lab - CRDH2 from anti-Fzd VH chain
GIINZSSGSTTYA

SEQ ID NO: 1009 - protein, 12 aa, Artificial Sequence
  Made in Lab - CRDH2 from anti-Fzd VH chain
STIGTGGGTYYA

SEQ ID NO: 1010 - protein, 12 aa, Artificial Sequence
  Made in Lab - CRDH2 from anti-Fzd VH chain
GIIDAGGRTSNA

SEQ ID NO: 1011 - protein, 12 aa, Artificial Sequence
  Made in Lab - CRDH2 from anti-Fzd VH chain
SSIGVNGDTYYL

SEQ ID NO: 1012 - protein, 13 aa, Artificial Sequence
  Made in Lab - CRDH2 from anti-Fzd VH chain
GIINPSGGSTZYA

SEQ ID NO: 1013 - protein, 13 aa, Artificial Sequence
  Made in Lab - CRDH2 from anti-Fzd VH chain
EZINPSGGSTSYA

SEQ ID NO: 1014 - protein, 12 aa, Artificial Sequence
  Made in Lab - CRDH2 from anti-Fzd VH chain
STIGTGGGTYYA

SEQ ID NO: 1015 - protein, 12 aa, Artificial Sequence
  Made in Lab - CRDH2 from anti-Fzd VH chain
SSIGVNGDTYYL

SEQ ID NO: 1016 - protein, 13 aa, Artificial Sequence
  Made in Lab - CRDH2 from anti-Fzd VH chain
GIINPSGGSTSYA

SEQ ID NO: 1017 - protein, 13 aa, Artificial Sequence
  Made in Lab - CRDH2 from anti-Fzd VH chain
GIINPRDGDTVYA

SEQ ID NO: 1018 - protein, 13 aa, Artificial Sequence
  Made in Lab - CRDH2 from anti-Fzd VH chain
GIINPSSGSTTYA

SEQ ID NO: 1019 - protein, 13 aa, Artificial Sequence
  Made in Lab - CRDH2 from anti-Fzd VH chain
GIINPSGGSTSYA

SEQ ID NO: 1020 - protein, 13 aa, Artificial Sequence
  Made in Lab - CRDH2 from anti-Fzd VH chain
GIINZSGGSTSYA

SEQ ID NO: 1021 - protein, 13 aa, Artificial Sequence
  Made in Lab - CRDH2 from anti-Fzd VH chain
GIINPSGGSTSYA

SEQ ID NO: 1022 - protein, 12 aa, Artificial Sequence
  Made in Lab - CRDH2 from anti-Fzd VH chain
SSIGVNGDTYYL

SEQ ID NO: 1023 - protein, 13 aa, Artificial Sequence
  Made in Lab - CRDH2 from anti-Fzd VH chain
GWIIPFSGTVNYA

SEQ ID NO: 1024 - protein, 13 aa, Artificial Sequence
  Made in Lab - CRDH2 from anti-Fzd VH chain
SSISSSGSYIDYA

SEQ ID NO: 1025 - protein, 13 aa, Artificial Sequence
  Made in Lab - CRDH2 from anti-Fzd VH chain
SGINWNGGSTGYA

SEQ ID NO: 1026 - protein, 13 aa, Artificial Sequence
  Made in Lab - CRDH2 from anti-Fzd VH chain
GWINPNNGGTDYA

SEQ ID NO: 1027 - protein, 13 aa, Artificial Sequence
  Made in Lab - CRDH2 from anti-Fzd VH chain
GWINPNSGGTNYA

SEQ ID NO: 1028 - protein, 13 aa, Artificial Sequence
  Made in Lab - CRDH2 from anti-Fzd VH chain
GWINPSSGDTKYA

SEQ ID NO: 1029 - protein, 13 aa, Artificial Sequence
  Made in Lab - CRDH2 from anti-Fzd VH chain
SAISGSGGSTYYA

SEQ ID NO: 1030 - protein, 13 aa, Artificial Sequence
  Made in Lab - CRDH2 from anti-Fzd VH chain
GIIDPSGGSTSYA

SEQ ID NO: 1031 - protein, 13 aa, Artificial Sequence
  Made in Lab - CRDH2 from anti-Fzd VH chain
GWMNPSRGNTVYA

SEQ ID NO: 1032 - protein, 13 aa, Artificial Sequence
  Made in Lab - CRDH2 from anti-Fzd VH chain
GMINPIFGTAKYA

SEQ ID NO: 1033 - protein, 13 aa, Artificial Sequence
  Made in Lab - CRDH2 from anti-Fzd VH chain
SSISSSSSYIYYA

SEQ ID NO: 1034 - protein, 13 aa, Artificial Sequence
  Made in Lab - CRDH2 from anti-Fzd VH chain
AVISKDGSQRYYA

SEQ ID NO: 1035 - protein, 13 aa, Artificial Sequence
  Made in Lab - CRDH2 from anti-Fzd VH chain
GWMNPNTGNTGYA

SEQ ID NO: 1036 - protein, 13 aa, Artificial Sequence
  Made in Lab - CRDH2 from anti-Fzd VH chain
GIINPSAGSTNYA

SEQ ID NO: 1037 - protein, 13 aa, Artificial Sequence
  Made in Lab - CRDH2 from anti-Fzd VH chain
GRINPNSGGTDYA

SEQ ID NO: 1038 - protein, 13 aa, Artificial Sequence
  Made in Lab - CRDH2 from anti-Fzd VH chain
GIINPSGGSTSYA

SEQ ID NO: 1039 - protein, 13 aa, Artificial Sequence
  Made in Lab - CRDH2 from anti-Fzd VH chain
SHIKSDGSSTRYA

SEQ ID NO: 1040 - protein, 13 aa, Artificial Sequence
  Made in Lab - CRDH2 from anti-Fzd VH chain
GIINPSGGSTSYA

SEQ ID NO: 1041 - protein, 13 aa, Artificial Sequence
  Made in Lab - CRDH2 from anti-Fzd VH chain
GWMNPSSGNTGYA

SEQ ID NO: 1042 - protein, 13 aa, Artificial Sequence
  Made in Lab - CRDH2 from anti-Fzd VH chain
GRINPNSGGTNYA

SEQ ID NO: 1043 - protein, 13 aa, Artificial Sequence
  Made in Lab - CRDH2 from anti-Fzd VH chain
GWINPNSGGTKFA

SEQ ID NO: 1044 - protein, 13 aa, Artificial Sequence
  Made in Lab - CRDH2 from anti-Fzd VH chain
GWISAYNGNTQHA

SEQ ID NO: 1045 - protein, 13 aa, Artificial Sequence
  Made in Lab - CRDH2 from anti-Fzd VH chain
SAISGTGDNTYYA

SEQ ID NO: 1046 - protein, 13 aa, Artificial Sequence
  Made in Lab - CRDH2 from anti-Fzd VH chain
AIINPNGGATSYA

SEQ ID NO: 1047 - protein, 13 aa, Artificial Sequence
  Made in Lab - CRDH2 from anti-Fzd VH chain
GRMNPNSGNTVYA

SEQ ID NO: 1048 - protein, 13 aa, Artificial Sequence
  Made in Lab - CRDH2 from anti-Fzd VH chain
TGISYDASKEYYA

SEQ ID NO: 1049 - protein, 13 aa, Artificial Sequence
  Made in Lab - CRDH2 from anti-Fzd VH chain
GIINPTSGKTSYA

SEQ ID NO: 1050 - protein, 13 aa, Artificial Sequence
  Made in Lab - CRDH2 from anti-Fzd VH chain
GWINPNSGGTNYA

SEQ ID NO: 1051 - protein, 13 aa, Artificial Sequence
  Made in Lab - CRDH2 from anti-Fzd VH chain
GIIDPNSGRTSYA

SEQ ID NO: 1052 - protein, 13 aa, Artificial Sequence
  Made in Lab - CRDH2 from anti-Fzd VH chain
SAISTSGDSTYYA

SEQ ID NO: 1053 - protein, 13 aa, Artificial Sequence
  Made in Lab - CRDH2 from anti-Fzd VH chain
SAISGSGGSTYYA

SEQ ID NO: 1054 - protein, 13 aa, Artificial Sequence
  Made in Lab - CRDH2 from anti-Fzd VH chain
GWMNPSSGNTGYA

SEQ ID NO: 1055 - protein, 13 aa, Artificial Sequence
  Made in Lab - CRDH2 from anti-Fzd VH chain
GWMDPYSGNTGYA

SEQ ID NO: 1056 - protein, 13 aa, Artificial Sequence
  Made in Lab - CRDH2 from anti-Fzd VH chain
GWMNPNSGNTGYA

SEQ ID NO: 1057 - protein, 13 aa, Artificial Sequence
  Made in Lab - CRDH2 from anti-Fzd VH chain
GGINPNSGGTNYA

SEQ ID NO: 1058 - protein, 13 aa, Artificial Sequence
  Made in Lab - CRDH2 from anti-Fzd VH chain
GIINPNSGDTGYA

SEQ ID NO: 1059 - protein, 13 aa, Artificial Sequence
  Made in Lab - CRDH2 from anti-Fzd VH chain
GIINPSGGSTTYA

SEQ ID NO: 1060 - protein, 13 aa, Artificial Sequence
  Made in Lab - CRDH2 from anti-Fzd VH chain
ATISGTGGSIYYA

SEQ ID NO: 1061 - protein, 13 aa, Artificial Sequence
  Made in Lab - CRDH2 from anti-Fzd VH chain
GWISADNGNTNYA

SEQ ID NO: 1062 - protein, 13 aa, Artificial Sequence
  Made in Lab - CRDH2 from anti-Fzd VH chain
SVISGSGGTTYYA

SEQ ID NO: 1063 - protein, 13 aa, Artificial Sequence
  Made in Lab - CRDH2 from anti-Fzd VH chain
GWINPNSGGTNYA

SEQ ID NO: 1064 - protein, 13 aa, Artificial Sequence
  Made in Lab - CRDH2 from anti-Fzd VH chain
GGTIPIYGTTNYA

SEQ ID NO: 1065 - protein, 12 aa, Artificial Sequence
  Made in Lab - CRDH2 from anti-Fzd VH chain
SAIGTGGGTYYA

SEQ ID NO: 1066 - protein, 13 aa, Artificial Sequence
  Made in Lab - CRDH2 from anti-Fzd VH chain
SAMNFNTGSTYYA

SEQ ID NO: 1067 - protein, 13 aa, Artificial Sequence
  Made in Lab - CRDH2 from anti-Fzd VH chain
GMINPDVGSTSYA

SEQ ID NO: 1068 - protein, 13 aa, Artificial Sequence
  Made in Lab - CRDH2 from anti-Fzd VH chain
SAISGSGGSTYYA

SEQ ID NO: 1069 - protein, 13 aa, Artificial Sequence
  Made in Lab - CRDH2 from anti-Fzd VH chain
GIINPSGGRTSYA

SEQ ID NO: 1070 - protein, 13 aa, Artificial Sequence
  Made in Lab - CRDH2 from anti-Fzd VH chain
GWISAYNGNTNYA

SEQ ID NO: 1071 - protein, 13 aa, Artificial Sequence
  Made in Lab - CRDH2 from anti-Fzd VH chain
GWMNPNSGNTGYA

SEQ ID NO: 1072 - protein, 13 aa, Artificial Sequence
  Made in Lab - CRDH2 from anti-Fzd VH chain
GWINPNSGGTNYA

SEQ ID NO: 1073 - protein, 13 aa, Artificial Sequence
  Made in Lab - CRDH2 from anti-Fzd VH chain
GWINPKSGGTHFA

SEQ ID NO: 1074 - protein, 13 aa, Artificial Sequence
  Made in Lab - CRDH2 from anti-Fzd VH chain
GRITPSDGTTTYA

SEQ ID NO: 1075 - protein, 13 aa, Artificial Sequence
  Made in Lab - CRDH2 from anti-Fzd VH chain
GIINPSGGSTSYA

SEQ ID NO: 1076 - protein, 12 aa, Artificial Sequence
  Made in Lab - CRDH2 from anti-Fzd VH chain
SAIGIGGGTYYA

SEQ ID NO: 1077 - protein, 13 aa, Artificial Sequence
  Made in Lab - CRDH2 from anti-Fzd VH chain
GWMNPNSGNTGYA

SEQ ID NO: 1078 - protein, 13 aa, Artificial Sequence
  Made in Lab - CRDH2 from anti-Fzd VH chain
SAISGSAAGTYYA

SEQ ID NO: 1079 - protein, 13 aa, Artificial Sequence
  Made in Lab - CRDH2 from anti-Fzd VH chain
GIINPSGGSTSYA

SEQ ID NO: 1080 - protein, 13 aa, Artificial Sequence
  Made in Lab - CRDH2 from anti-Fzd VH chain
SGLSASGANTYYA

SEQ ID NO: 1081 - protein, 13 aa, Artificial Sequence
  Made in Lab - CRDH2 from anti-Fzd VH chain
GWMNPHSGNTGLA

SEQ ID NO: 1082 - protein, 13 aa, Artificial Sequence
  Made in Lab - CRDH2 from anti-Fzd VH chain
GIINPSGGSTSYA

SEQ ID NO: 1083 - protein, 12 aa, Artificial Sequence
  Made in Lab - CRDH2 from anti-Fzd VH chain
SAIGTGGGTYYA

SEQ ID NO: 1084 - protein, 13 aa, Artificial Sequence
  Made in Lab - CRDH2 from anti-Fzd VH chain
AVISKDESNKYYA

SEQ ID NO: 1085 - protein, 13 aa, Artificial Sequence
  Made in Lab - CRDH2 from anti-Fzd VH chain
GWMNPNSGNTGYA

SEQ ID NO: 1086 - protein, 13 aa, Artificial Sequence
  Made in Lab - CRDH2 from anti-Fzd VH chain
GIINPSGGATSYA

SEQ ID NO: 1087 - protein, 13 aa, Artificial Sequence
  Made in Lab - CRDH2 from anti-Fzd VH chain
GIIDPNSGRTGYA

SEQ ID NO: 1088 - protein, 13 aa, Artificial Sequence
  Made in Lab - CRDH2 from anti-Fzd VH chain
GWINPNSGGTNYA

SEQ ID NO: 1089 - protein, 13 aa, Artificial Sequence
  Made in Lab - CRDH2 from anti-Fzd VH chain
AIINPNGGATSYA

SEQ ID NO: 1090 - protein, 13 aa, Artificial Sequence
  Made in Lab - CRDH2 from anti-Fzd VH chain
  misc_feature (5)..(5): Xaa can be any naturally occurring amino acid
STISXNSRSIDYA

SEQ ID NO: 1091 - protein, 13 aa, Artificial Sequence
  Made in Lab - CRDH2 from anti-Fzd VH chain
GRINPSGGRTTYA

SEQ ID NO: 1092 - protein, 13 aa, Artificial Sequence
  Made in Lab - CRDH2 from anti-Fzd VH chain
GRINPNSGGTNYA

SEQ ID NO: 1093 - protein, 13 aa, Artificial Sequence
  Made in Lab - CRDH2 from anti-Fzd VH chain
GRINPINGGTNYA

SEQ ID NO: 1094 - protein, 13 aa, Artificial Sequence
  Made in Lab - CRDH2 from anti-Fzd VH chain
GWINPNSGGTNYA

SEQ ID NO: 1095 - protein, 13 aa, Artificial Sequence
  Made in Lab - CRDH2 from anti-Fzd VH chain
SAISGSGGSTYYA

SEQ ID NO: 1096 - protein, 13 aa, Artificial Sequence
  Made in Lab - CRDH2 from anti-Fzd VH chain
GIINPSGGSTSYA

SEQ ID NO: 1097 - protein, 13 aa, Artificial Sequence
  Made in Lab - CRDH2 from anti-Fzd VH chain
GIINPSGGSTTYA

SEQ ID NO: 1098 - protein, 13 aa, Artificial Sequence
  Made in Lab - CRDH2 from anti-Fzd VH chain
SGISGSSASTYYA

SEQ ID NO: 1099 - protein, 13 aa, Artificial Sequence
  Made in Lab - CRDH2 from anti-Fzd VH chain
SGVDGSGGKTYYA

SEQ ID NO: 1100 - protein, 13 aa, Artificial Sequence
  Made in Lab - CRDH2 from anti-Fzd VH chain
GWMSPKNGDTRFA

SEQ ID NO: 1101 - protein, 13 aa, Artificial Sequence
  Made in Lab - CRDH2 from anti-Fzd VH chain
SAISGSGGSTYYA

SEQ ID NO: 1102 - protein, 13 aa, Artificial Sequence
  Made in Lab - CRDH2 from anti-Fzd VH chain
GIINPSGGSTSYA

SEQ ID NO: 1103 - protein, 12 aa, Artificial Sequence
  Made in Lab - CRDH2 from anti-Fzd VH chain
SAISFGGSTYYA

SEQ ID NO: 1104 - protein, 13 aa, Artificial Sequence
  Made in Lab - CRDH2 from anti-Fzd VH chain
SAISASGGRTYYA

SEQ ID NO: 1105 - protein, 13 aa, Artificial Sequence
  Made in Lab - CRDH2 from anti-Fzd VH chain
SGISGSGGSTFYA

SEQ ID NO: 1106 - protein, 13 aa, Artificial Sequence
  Made in Lab - CRDH2 from anti-Fzd VH chain
GVINPSGGSANYA

SEQ ID NO: 1107 - protein, 13 aa, Artificial Sequence
  Made in Lab - CRDH2 from anti-Fzd VH chain
SAISGSGGSTYYA

SEQ ID NO: 1108 - protein, 13 aa, Artificial Sequence
  Made in Lab - CRDH2 from anti-Fzd VH chain
GGIIPLFGTTNYA

SEQ ID NO: 1109 - protein, 13 aa, Artificial Sequence
  Made in Lab - CRDH2 from anti-Fzd VH chain
GWMNPNSGNTGYA

SEQ ID NO: 1110 - protein, 12 aa, Artificial Sequence
  Made in Lab - CRDH2 from anti-Fzd VH chain
SAIGAGGGTYYA

SEQ ID NO: 1111 - protein, 13 aa, Artificial Sequence
  Made in Lab - CRDH2 from anti-Fzd VH chain
GIINPSGGSATYA

SEQ ID NO: 1112 - protein, 13 aa, Artificial Sequence
  Made in Lab - CRDH2 from anti-Fzd VH chain
GWINPNSGDTKYS

SEQ ID NO: 1113 - protein, 13 aa, Artificial Sequence
  Made in Lab - CRDH2 from anti-Fzd VH chain
GWINPNNGGTNYA

SEQ ID NO: 1114 - protein, 13 aa, Artificial Sequence
  Made in Lab - CRDH2 from anti-Fzd VH chain
GIINPNSGGTNYA

SEQ ID NO: 1115 - protein, 13 aa, Artificial Sequence
  Made in Lab - CRDH2 from anti-Fzd VH chain
GIINPSGGSTSYA

SEQ ID NO: 1116 - protein, 13 aa, Artificial Sequence
  Made in Lab - CRDH2 from anti-Fzd VH chain
GIINPNGGSANYA

SEQ ID NO: 1117 - protein, 13 aa, Artificial Sequence
  Made in Lab - CRDH2 from anti-Fzd VH chain
SYSSGNSGYTNYA

SEQ ID NO: 1118 - protein, 13 aa, Artificial Sequence
  Made in Lab - CRDH2 from anti-Fzd VH chain
GIINPSAGRTRYA

SEQ ID NO: 1119 - protein, 13 aa, Artificial Sequence
  Made in Lab - CRDH2 from anti-Fzd VH chain
GAIDPSGGSTNYA

SEQ ID NO: 1120 - protein, 13 aa, Artificial Sequence
  Made in Lab - CRDH2 from anti-Fzd VH chain
SAISSGSAYTYYA

SEQ ID NO: 1121 - protein, 13 aa, Artificial Sequence
  Made in Lab - CRDH2 from anti-Fzd VH chain
AVISYDGSNKYYA

SEQ ID NO: 1122 - protein, 13 aa, Artificial Sequence
  Made in Lab - CRDH2 from anti-Fzd VH chain
AVISYDGSNKYYA

SEQ ID NO: 1123 - protein, 13 aa, Artificial Sequence
  Made in Lab - CRDH2 from anti-Fzd VH chain
GIINPSGGSTSYA

SEQ ID NO: 1124 - protein, 13 aa, Artificial Sequence
  Made in Lab - CRDH2 from anti-Fzd VH chain
ZVISYDGSNKYYA

SEQ ID NO: 1125 - protein, 13 aa, Artificial Sequence
  Made in Lab - CRDH2 from anti-Fzd VH chain
GRITPIFGSADYA

SEQ ID NO: 1126 - protein, 13 aa, Artificial Sequence
  Made in Lab - CRDH2 from anti-Fzd VH chain
GWMNPNSGNTGYA

SEQ ID NO: 1127 - protein, 13 aa, Artificial Sequence
  Made in Lab - CRDH2 from anti-Fzd VH chain
GIINPSGGTTSYA

SEQ ID NO: 1128 - protein, 13 aa, Artificial Sequence
  Made in Lab - CRDH2 from anti-Fzd VH chain
GMINPSGGSTSYA

SEQ ID NO: 1129 - protein, 13 aa, Artificial Sequence
  Made in Lab - CRDH2 from anti-Fzd VH chain
GWMNPNSGNTGYA

SEQ ID NO: 1130 - protein, 13 aa, Artificial Sequence
  Made in Lab - CRDH2 from anti-Fzd VH chain
GRINHNSGGTNYA

SEQ ID NO: 1131 - protein, 13 aa, Artificial Sequence
  Made in Lab - CRDH2 from anti-Fzd VH chain
GGITPIFGTAKYA

SEQ ID NO: 1132 - protein, 14 aa, Artificial Sequence
  Made in Lab - CRDH2 from anti-Fzd VH chain
GRTYQRSKWFTYYA

SEQ ID NO: 1133 - protein, 13 aa, Artificial Sequence
  Made in Lab - CRDH2 from anti-Fzd VH chain
GRINPNSGGTNYA

SEQ ID NO: 1134 - protein, 13 aa, Artificial Sequence
  Made in Lab - CRDH2 from anti-Fzd VH chain
AVISYDGSNKYYA

SEQ ID NO: 1135 - protein, 13 aa, Artificial Sequence
  Made in Lab - CRDH2 from anti-Fzd VH chain
AZIZYDGSNKZYA

SEQ ID NO: 1136 - protein, 13 aa, Artificial Sequence
  Made in Lab - CRDH2 from anti-Fzd VH chain
AVISYDGSNKYYA

SEQ ID NO: 1137 - protein, 13 aa, Artificial Sequence
  Made in Lab - CRDH2 from anti-Fzd VH chain
AVISYDGSNKYYA

SEQ ID NO: 1138 - protein, 13 aa, Artificial Sequence
  Made in Lab - CRDH2 from anti-Fzd VH chain
SRINNDGRITSYA

SEQ ID NO: 1139 - protein, 13 aa, Artificial Sequence
  Made in Lab - CRDH2 from anti-Fzd VH chain
  misc_feature (12)..(12): Xaa can be any naturally occurring amino acid
TVIZZZGSNKZXA

SEQ ID NO: 1140 - protein, 15 aa, Artificial Sequence
  Made in Lab - CRDH2 from anti-Fzd VH chain
GFIRSKAYGGTTEYA

SEQ ID NO: 1141 - protein, 13 aa, Artificial Sequence
  Made in Lab - CRDH2 from anti-Fzd VH chain
AVISYDGSNKYYA

SEQ ID NO: 1142 - protein, 13 aa, Artificial Sequence
  Made in Lab - CRDH2 from anti-Fzd VH chain
AVISYDGSNKZYA

SEQ ID NO: 1143 - protein, 14 aa, Artificial Sequence
  Made in Lab - CRDH2 from anti-Fzd VH chain
GRTYYRSKWYNDYA

SEQ ID NO: 1144 - protein, 13 aa, Artificial Sequence
  Made in Lab - CRDH2 from anti-Fzd VH chain
AVISYDGSNKYYA

SEQ ID NO: 1145 - protein, 13 aa, Artificial Sequence
  Made in Lab - CRDH2 from anti-Fzd VH chain
AVISYDGSNKYYA

SEQ ID NO: 1146 - protein, 13 aa, Artificial Sequence
  Made in Lab - CRDH2 from anti-Fzd VH chain
AVISYDGSNKYYA

SEQ ID NO: 1147 - protein, 13 aa, Artificial Sequence
  Made in Lab - CRDH2 from anti-Fzd VH chain
AVISYDGSNKYYA

SEQ ID NO: 1148 - protein, 13 aa, Artificial Sequence
  Made in Lab - CRDH2 from anti-Fzd VH chain
AVISYDGSNKYYA

SEQ ID NO: 1149 - protein, 13 aa, Artificial Sequence
  Made in Lab - CRDH2 from anti-Fzd VH chain
AVISYDGSNKYYA

SEQ ID NO: 1150 - protein, 14 aa, Artificial Sequence
  Made in Lab - CRDH2 from anti-Fzd VH chain
GRTZYRSKWYNDYA

SEQ ID NO: 1151 - protein, 13 aa, Artificial Sequence
  Made in Lab - CRDH2 from anti-Fzd VH chain
AVISYDGSNKYYA

SEQ ID NO: 1152 - protein, 13 aa, Artificial Sequence
  Made in Lab - CRDH2 from anti-Fzd VH chain
AZISYDGSNKZYA

SEQ ID NO: 1153 - protein, 13 aa, Artificial Sequence
  Made in Lab - CRDH2 from anti-Fzd VH chain
AVISYDGSNKYYA

SEQ ID NO: 1154 - protein, 13 aa, Artificial Sequence
  Made in Lab - CRDH2 from anti-Fzd VH chain
AVISYDGSNKYYA

SEQ ID NO: 1155 - protein, 13 aa, Artificial Sequence
  Made in Lab - CRDH2 from anti-Fzd VH chain
AVISYDGSNKYYA

SEQ ID NO: 1156 - protein, 13 aa, Artificial Sequence
  Made in Lab - CRDH2 from anti-Fzd VH chain
AVISYDGSNKYYA

SEQ ID NO: 1157 - protein, 13 aa, Artificial Sequence
  Made in Lab - CRDH2 from anti-Fzd VH chain
SAISGSGGSTYYA

SEQ ID NO: 1158 - protein, 13 aa, Artificial Sequence
  Made in Lab - CRDH2 from anti-Fzd VH chain
AVISYDGSNKYYA

SEQ ID NO: 1159 - protein, 13 aa, Artificial Sequence
  Made in Lab - CRDH2 from anti-Fzd VH chain
GIINPSGGSTSYA

SEQ ID NO: 1160 - protein, 13 aa, Artificial Sequence
  Made in Lab - CRDH2 from anti-Fzd VH chain
AVISYDGSNKYYA

SEQ ID NO: 1161 - protein, 12 aa, Artificial Sequence
  Made in Lab - CRDH2 from anti-Fzd VH chain
GSIYYSGSTYYN

SEQ ID NO: 1162 - protein, 13 aa, Artificial Sequence
  Made in Lab - CRDH2 from anti-Fzd VH chain
AVISYDGSNKYYA

SEQ ID NO: 1163 - protein, 13 aa, Artificial Sequence
  Made in Lab - CRDH2 from anti-Fzd VH chain
AVISYDGSNKYYA

SEQ ID NO: 1164 - protein, 13 aa, Artificial Sequence
  Made in Lab - CRDH2 from anti-Fzd VH chain
AVISYDGSNKYYA

SEQ ID NO: 1165 - protein, 12 aa, Artificial Sequence
  Made in Lab - CRDH2 from anti-Fzd VH chain
YHHMZEADZZYA

SEQ ID NO: 1166 - protein, 13 aa, Artificial Sequence
  Made in Lab - CRDH2 from anti-Fzd VH chain
AVISYDGSNKYYA

SEQ ID NO: 1167 - protein, 13 aa, Artificial Sequence
  Made in Lab - CRDH2 from anti-Fzd VH chain
AVISYDGSNKYYA

SEQ ID NO: 1168 - protein, 13 aa, Artificial Sequence
  Made in Lab - CRDH2 from anti-Fzd VH chain
SGISGSGGNTYYA

SEQ ID NO: 1169 - protein, 13 aa, Artificial Sequence
  Made in Lab - CRDH2 from anti-Fzd VH chain
AVISYZZSNKZYA

SEQ ID NO: 1170 - protein, 13 aa, Artificial Sequence
  Made in Lab - CRDH2 from anti-Fzd VH chain
AVISYDGSNKYYA

SEQ ID NO: 1171 - protein, 13 aa, Artificial Sequence
  Made in Lab - CRDH2 from anti-Fzd VH chain
ANIKTDGSEKYYV

SEQ ID NO: 1172 - protein, 13 aa, Artificial Sequence
  Made in Lab - CRDH2 from anti-Fzd VH chain
AVISYDGSNKYYA

SEQ ID NO: 1173 - protein, 13 aa, Artificial Sequence
  Made in Lab - CRDH2 from anti-Fzd VH chain
AVISYDGSNKYYA

SEQ ID NO: 1174 - protein, 13 aa, Artificial Sequence
  Made in Lab - CRDH2 from anti-Fzd VH chain
AVISYDGSNKYYA

SEQ ID NO: 1175 - protein, 13 aa, Artificial Sequence
  Made in Lab - CRDH2 from anti-Fzd VH chain
SAISGSGGSTYYA

SEQ ID NO: 1176 - protein, 13 aa, Artificial Sequence
  Made in Lab - CRDH2 from anti-Fzd VH chain
SGISGSSGNTYYA

SEQ ID NO: 1177 - protein, 13 aa, Artificial Sequence
  Made in Lab - CRDH2 from anti-Fzd VH chain
SAISGSGGSTYYA

SEQ ID NO: 1178 - protein, 15 aa, Artificial Sequence
  Made in Lab - CRDH2 from anti-Fzd VH chain
GFIRSKTYGGTTEYA

SEQ ID NO: 1179 - protein, 13 aa, Artificial Sequence
  Made in Lab - CRDH2 from anti-Fzd VH chain
SGISGSGDSTZYA

SEQ ID NO: 1180 - protein, 13 aa, Artificial Sequence
  Made in Lab - CRDH2 from anti-Fzd VH chain
SAISGSGGSTYYA

SEQ ID NO: 1181 - protein, 13 aa, Artificial Sequence
  Made in Lab - CRDH2 from anti-Fzd VH chain
SAISSNGGSTZYA

SEQ ID NO: 1182 - protein, 13 aa, Artificial Sequence
  Made in Lab - CRDH2 from anti-Fzd VH chain
SAISGSGGSTYYA

SEQ ID NO: 1183 - protein, 13 aa, Artificial Sequence
  Made in Lab - CRDH2 from anti-Fzd VH chain
AVISYDGSNKYYA

SEQ ID NO: 1184 - protein, 13 aa, Artificial Sequence
  Made in Lab - CRDH2 from anti-Fzd VH chain
AVISZDGSNKZYA

SEQ ID NO: 1185 - protein, 13 aa, Artificial Sequence
  Made in Lab - CRDH2 from anti-Fzd VH chain
  misc_feature (11)..(11): Xaa can be any naturally occurring amino acid
AVISYDGSNKXYA

SEQ ID NO: 1186 - protein, 13 aa, Artificial Sequence
  Made in Lab - CRDH2 from anti-Fzd VH chain
GGIIPIFGTANYA

SEQ ID NO: 1187 - protein, 13 aa, Artificial Sequence
  Made in Lab - CRDH2 from anti-Fzd VH chain
GWINAGNGNTKYS

SEQ ID NO: 1188 - protein, 13 aa, Artificial Sequence
  Made in Lab - CRDH2 from anti-Fzd VH chain
AVISYDGSNKYYA

SEQ ID NO: 1189 - protein, 13 aa, Artificial Sequence
  Made in Lab - CRDH2 from anti-Fzd VH chain
AZISYDGSNKZYA

SEQ ID NO: 1190 - protein, 13 aa, Artificial Sequence
  Made in Lab - CRDH2 from anti-Fzd VH chain
AVISYDGSNKYYA

SEQ ID NO: 1191 - protein, 13 aa, Artificial Sequence
  Made in Lab - CRDH2 from anti-Fzd VH chain
AVISYDGSNKYYA

SEQ ID NO: 1192 - protein, 13 aa, Artificial Sequence
  Made in Lab - CRDH2 from anti-Fzd VH chain
SAISSNGGSTYYA

SEQ ID NO: 1193 - protein, 13 aa, Artificial Sequence
  Made in Lab - CRDH2 from anti-Fzd VH chain
AVISYDGSNKYYA

SEQ ID NO: 1194 - protein, 13 aa, Artificial Sequence
  Made in Lab - CRDH2 from anti-Fzd VH chain
AVISYDGSNKYYA

SEQ ID NO: 1195 - protein, 13 aa, Artificial Sequence
  Made in Lab - CRDH2 from anti-Fzd VH chain
AVISYDGSNKYYA

SEQ ID NO: 1196 - protein, 13 aa, Artificial Sequence
  Made in Lab - CRDH2 from anti-Fzd VH chain
SAISGSGGSTYYA

SEQ ID NO: 1197 - protein, 13 aa, Artificial Sequence
  Made in Lab - CRDH2 from anti-Fzd VH chain
SAISGSGGSTYYA

SEQ ID NO: 1198 - protein, 13 aa, Artificial Sequence
  Made in Lab - CRDH2 from anti-Fzd VH chain
AVISYDGSNKYYA

SEQ ID NO: 1199 - protein, 13 aa, Artificial Sequence
  Made in Lab - CRDH2 from anti-Fzd VH chain
GIINPSGGRTTYA

SEQ ID NO: 1200 - protein, 13 aa, Artificial Sequence
  Made in Lab - CRDH2 from anti-Fzd VH chain
GIINPSSGSTSYA

SEQ ID NO: 1201 - protein, 13 aa, Artificial Sequence
  Made in Lab - CRDH2 from anti-Fzd VH chain
GVIDPTGEATLYA

SEQ ID NO: 1202 - protein, 13 aa, Artificial Sequence
  Made in Lab - CRDH2 from anti-Fzd VH chain
GIINPSGGSTSYA

SEQ ID NO: 1203 - protein, 13 aa, Artificial Sequence
  Made in Lab - CRDH2 from anti-Fzd VH chain
GRINPHTGGTNYA

SEQ ID NO: 1204 - protein, 13 aa, Artificial Sequence
  Made in Lab - CRDH2 from anti-Fzd VH chain
GVINPSGGITSYA

SEQ ID NO: 1205 - protein, 13 aa, Artificial Sequence
  Made in Lab - CRDH2 from anti-Fzd VH chain
GIINPTDGGTTYA

SEQ ID NO: 1206 - protein, 13 aa, Artificial Sequence
  Made in Lab - CRDH2 from anti-Fzd VH chain
AAVSRSGGSTFYA

SEQ ID NO: 1207 - protein, 13 aa, Artificial Sequence
  Made in Lab - CRDH2 from anti-Fzd VH chain
GWMNPNSGNTGYA

SEQ ID NO: 1208 - protein, 13 aa, Artificial Sequence
  Made in Lab - CRDH2 from anti-Fzd VH chain
SSISSSSSYIYYA

SEQ ID NO: 1209 - protein, 13 aa, Artificial Sequence
  Made in Lab - CRDH2 from anti-Fzd VH chain
GIINPRNGRTSYA

SEQ ID NO: 1210 - protein, 13 aa, Artificial Sequence
  Made in Lab - CRDH2 from anti-Fzd VH chain
SGINWNGGSTGYA

SEQ ID NO: 1211 - protein, 13 aa, Artificial Sequence
  Made in Lab - CRDH2 from anti-Fzd VH chain
SAISGSGGSTYYA

SEQ ID NO: 1212 - protein, 13 aa, Artificial Sequence
  Made in Lab - CRDH2 from anti-Fzd VH chain
GWMNPNSGNTZYA

SEQ ID NO: 1213 - protein, 13 aa, Artificial Sequence
  Made in Lab - CRDH2 from anti-Fzd VH chain
GIINPSGGSTTYA

SEQ ID NO: 1214 - protein, 13 aa, Artificial Sequence
  Made in Lab - CRDH2 from anti-Fzd VH chain
GIISPSGGGTSYP

SEQ ID NO: 1215 - protein, 13 aa, Artificial Sequence
  Made in Lab - CRDH2 from anti-Fzd VH chain
GIINARTGTTDYA

SEQ ID NO: 1216 - protein, 13 aa, Artificial Sequence
  Made in Lab - CRDH2 from anti-Fzd VH chain
SSISRDSRYIYYA

SEQ ID NO: 1217 - protein, 13 aa, Artificial Sequence
  Made in Lab - CRDH2 from anti-Fzd VH chain
SYISGDSGYTNYA

SEQ ID NO: 1218 - protein, 13 aa, Artificial Sequence
  Made in Lab - CRDH2 from anti-Fzd VH chain
GWMIPNSGNTAYA

SEQ ID NO: 1219 - protein, 13 aa, Artificial Sequence
  Made in Lab - CRDH2 from anti-Fzd VH chain
GMINPSSGSTNYA

SEQ ID NO: 1220 - protein, 13 aa, Artificial Sequence
  Made in Lab - CRDH2 from anti-Fzd VH chain
GIINPSGGSTSYA

SEQ ID NO: 1221 - protein, 13 aa, Artificial Sequence
  Made in Lab - CRDH2 from anti-Fzd VH chain
GIINPSRGNTNYA

SEQ ID NO: 1222 - protein, 13 aa, Artificial Sequence
  Made in Lab - CRDH2 from anti-Fzd VH chain
GIINPSGGSTSYA

SEQ ID NO: 1223 - protein, 13 aa, Artificial Sequence
  Made in Lab - CRDH2 from anti-Fzd VH chain
GIINPSGGSTSYA

SEQ ID NO: 1224 - protein, 13 aa, Artificial Sequence
  Made in Lab - CRDH2 from anti-Fzd VH chain
GIINPSGGSTSYA

SEQ ID NO: 1225 - protein, 13 aa, Artificial Sequence
  Made in Lab - CRDH2 from anti-Fzd VH chain
GWISAYNGNTKYV

SEQ ID NO: 1226 - protein, 13 aa, Artificial Sequence
  Made in Lab - CRDH2 from anti-Fzd VH chain
AGTSGSGESRDYA

SEQ ID NO: 1227 - protein, 13 aa, Artificial Sequence
  Made in Lab - CRDH2 from anti-Fzd VH chain
GWMNPNSGYTGYA

SEQ ID NO: 1228 - protein, 13 aa, Artificial Sequence
  Made in Lab - CRDH2 from anti-Fzd VH chain
GWMNPNSGNTGYA

SEQ ID NO: 1229 - protein, 13 aa, Artificial Sequence
  Made in Lab - CRDH2 from anti-Fzd VH chain
STISASGGNTYYA

SEQ ID NO: 1230 - protein, 13 aa, Artificial Sequence
  Made in Lab - CRDH2 from anti-Fzd VH chain
GIINPSGGSTSYA

SEQ ID NO: 1231 - protein, 13 aa, Artificial Sequence
  Made in Lab - CRDH2 from anti-Fzd VH chain
GIINPSDGETSYA

SEQ ID NO: 1232 - protein, 13 aa, Artificial Sequence
  Made in Lab - CRDH2 from anti-Fzd VH chain
GIINPVSGTTSYA

SEQ ID NO: 1233 - protein, 13 aa, Artificial Sequence
  Made in Lab - CRDH2 from anti-Fzd VH chain
GIINPSGGSTSYA

SEQ ID NO: 1234 - protein, 13 aa, Artificial Sequence
  Made in Lab - CRDH2 from anti-Fzd VH chain
GIINPSGGSTSYA

SEQ ID NO: 1235 - protein, 13 aa, Artificial Sequence
  Made in Lab - CRDH2 from anti-Fzd VH chain
GIINPSGGATIYA

SEQ ID NO: 1236 - protein, 13 aa, Artificial Sequence
  Made in Lab - CRDH2 from anti-Fzd VH chain
AGVSYDKSQEYYA

SEQ ID NO: 1237 - protein, 13 aa, Artificial Sequence
  Made in Lab - CRDH2 from anti-Fzd VH chain
GWMNPKSGNTGYS

SEQ ID NO: 1238 - protein, 13 aa, Artificial Sequence
  Made in Lab - CRDH2 from anti-Fzd VH chain
SAISASGGYTYYA

SEQ ID NO: 1239 - protein, 13 aa, Artificial Sequence
  Made in Lab - CRDH2 from anti-Fzd VH chain
GIINPSGGGTSYA

SEQ ID NO: 1240 - protein, 13 aa, Artificial Sequence
  Made in Lab - CRDH2 from anti-Fzd VH chain
GIINPSGGITSYA

SEQ ID NO: 1241 - protein, 13 aa, Artificial Sequence
  Made in Lab - CRDH2 from anti-Fzd VH chain
GWMNPYSGNTGYA

SEQ ID NO: 1242 - protein, 13 aa, Artificial Sequence
  Made in Lab - CRDH2 from anti-Fzd VH chain
GWMNPKSGNTGYA

SEQ ID NO: 1243 - protein, 13 aa, Artificial Sequence
  Made in Lab - CRDH2 from anti-Fzd VH chain
STIRASGGNTYYA

SEQ ID NO: 1244 - protein, 13 aa, Artificial Sequence
  Made in Lab - CRDH2 from anti-Fzd VH chain
GVINTGGGSVTYA

SEQ ID NO: 1245 - protein, 13 aa, Artificial Sequence
  Made in Lab - CRDH2 from anti-Fzd VH chain
GIINPSGGSTSYA

SEQ ID NO: 1246 - protein, 13 aa, Artificial Sequence
  Made in Lab - CRDH2 from anti-Fzd VH chain
GIINPSGGYSTYA

SEQ ID NO: 1247 - protein, 13 aa, Artificial Sequence
  Made in Lab - CRDH2 from anti-Fzd VH chain
GWMNPNSGNTGYA

SEQ ID NO: 1248 - protein, 13 aa, Artificial Sequence
  Made in Lab - CRDH2 from anti-Fzd VH chain
GIINPSSGSTSYA

SEQ ID NO: 1249 - protein, 13 aa, Artificial Sequence
  Made in Lab - CRDH2 from anti-Fzd VH chain
GWMSPNSGNAGFA

SEQ ID NO: 1250 - protein, 13 aa, Artificial Sequence
  Made in Lab - CRDH2 from anti-Fzd VH chain
GIINPSGGSTSYA

SEQ ID NO: 1251 - protein, 13 aa, Artificial Sequence
  Made in Lab - CRDH2 from anti-Fzd VH chain
GWINPHSGDTYYA

SEQ ID NO: 1252 - protein, 13 aa, Artificial Sequence
  Made in Lab - CRDH2 from anti-Fzd VH chain
SAISSSGASTYYA

SEQ ID NO: 1253 - protein, 13 aa, Artificial Sequence
  Made in Lab - CRDH2 from anti-Fzd VH chain
GWMSPNSGNTGYA

SEQ ID NO: 1254 - protein, 13 aa, Artificial Sequence
  Made in Lab - CRDH2 from anti-Fzd VH chain
GWISAYNGNTNYA

SEQ ID NO: 1255 - protein, 13 aa, Artificial Sequence
  Made in Lab - CRDH2 from anti-Fzd VH chain
GWMNVHTGNTGYA

SEQ ID NO: 1256 - protein, 13 aa, Artificial Sequence
  Made in Lab - CRDH2 from anti-Fzd VH chain
GWISAYNGNTNYA

SEQ ID NO: 1257 - protein, 13 aa, Artificial Sequence
  Made in Lab - CRDH2 from anti-Fzd VH chain
GIINPSGDGTNYA

SEQ ID NO: 1258 - protein, 13 aa, Artificial Sequence
  Made in Lab - CRDH2 from anti-Fzd VH chain
GWISAYNGNTNYA

SEQ ID NO: 1259 - protein, 13 aa, Artificial Sequence
  Made in Lab - CRDH2 from anti-Fzd VH chain
GIINPSGGGTSYA

SEQ ID NO: 1260 - protein, 13 aa, Artificial Sequence
  Made in Lab - CRDH2 from anti-Fzd VH chain
GDINPNNGGSRYN

SEQ ID NO: 1261 - protein, 13 aa, Artificial Sequence
  Made in Lab - CRDH2 from anti-Fzd VH chain
GMINPSGGSTTYA

SEQ ID NO: 1262 - protein, 13 aa, Artificial Sequence
  Made in Lab - CRDH2 from anti-Fzd VH chain
GGIIPIFGTANYA

SEQ ID NO: 1263 - protein, 13 aa, Artificial Sequence
  Made in Lab - CRDH2 from anti-Fzd VH chain
GWINPNSGNTGYA

SEQ ID NO: 1264 - protein, 13 aa, Artificial Sequence
  Made in Lab - CRDH2 from anti-Fzd VH chain
GWMNPNSGNTGYA

SEQ ID NO: 1265 - protein, 13 aa, Artificial Sequence
  Made in Lab - CRDH2 from anti-Fzd VH chain
GIINPNGGZTSYA

SEQ ID NO: 1266 - protein, 13 aa, Artificial Sequence
  Made in Lab - CRDH2 from anti-Fzd VH chain
GWINPNTGDTSFA

SEQ ID NO: 1267 - protein, 13 aa, Artificial Sequence
  Made in Lab - CRDH2 from anti-Fzd VH chain
GGIIPVFVTPRYA

SEQ ID NO: 1268 - protein, 13 aa, Artificial Sequence
  Made in Lab - CRDH2 from anti-Fzd VH chain
GIINPYGGGTSYG

SEQ ID NO: 1269 - protein, 13 aa, Artificial Sequence
  Made in Lab - CRDH2 from anti-Fzd VH chain
GWINPNGGZTSYA

SEQ ID NO: 1270 - protein, 13 aa, Artificial Sequence
  Made in Lab - CRDH2 from anti-Fzd VH chain
GWMNPNSGNTGYA

SEQ ID NO: 1271 - protein, 13 aa, Artificial Sequence
  Made in Lab - CRDH2 from anti-Fzd VH chain
GIINPNGGTTSYA

SEQ ID NO: 1272 - protein, 13 aa, Artificial Sequence
  Made in Lab - CRDH2 from anti-Fzd VH chain
GIINPSGGSTNYA

SEQ ID NO: 1273 - protein, 13 aa, Artificial Sequence
  Made in Lab - CRDH2 from anti-Fzd VH chain
GWIDPSSGATDYA

SEQ ID NO: 1274 - protein, 13 aa, Artificial Sequence
  Made in Lab - CRDH2 from anti-Fzd VH chain
GWINPNSGGTNYA

SEQ ID NO: 1275 - protein, 13 aa, Artificial Sequence
  Made in Lab - CRDH2 from anti-Fzd VH chain
GIIDPSGGSTDYA

SEQ ID NO: 1276 - protein, 13 aa, Artificial Sequence
  Made in Lab - CRDH2 from anti-Fzd VH chain
GIINPSSGNTNYA

SEQ ID NO: 1277 - protein, 13 aa, Artificial Sequence
  Made in Lab - CRDH2 from anti-Fzd VH chain
GRINPNGGNTSYA

SEQ ID NO: 1278 - protein, 13 aa, Artificial Sequence
  Made in Lab - CRDH2 from anti-Fzd VH chain
GWMNPNSGNTGYA

SEQ ID NO: 1279 - protein, 13 aa, Artificial Sequence
  Made in Lab - CRDH2 from anti-Fzd VH chain
GIINPSGGSTSYA

SEQ ID NO: 1280 - protein, 13 aa, Artificial Sequence
  Made in Lab - CRDH2 from anti-Fzd VH chain
GIINPSGGNTSYA

SEQ ID NO: 1281 - protein, 13 aa, Artificial Sequence
  Made in Lab - CRDH2 from anti-Fzd VH chain
GIINPSGAGTTYA

SEQ ID NO: 1282 - protein, 13 aa, Artificial Sequence
  Made in Lab - CRDH2 from anti-Fzd VH chain
GIINPZGGSTSYA

SEQ ID NO: 1283 - protein, 13 aa, Artificial Sequence
  Made in Lab - CRDH2 from anti-Fzd VH chain
GWINPZSGDTIYA

SEQ ID NO: 1284 - protein, 13 aa, Artificial Sequence
  Made in Lab - CRDH2 from anti-Fzd VH chain
GWINPSSGSTTYA

SEQ ID NO: 1285 - protein, 13 aa, Artificial Sequence
  Made in Lab - CRDH2 from anti-Fzd VH chain
GIINPNGGZTSYA

SEQ ID NO: 1286 - protein, 13 aa, Artificial Sequence
  Made in Lab - CRDH2 from anti-Fzd VH chain
GIINPZGGNTIYA

SEQ ID NO: 1287 - protein, 13 aa, Artificial Sequence
  Made in Lab - CRDH2 from anti-Fzd VH chain
GIINPYGGGTSYG

SEQ ID NO: 1288 - protein, 13 aa, Artificial Sequence
  Made in Lab - CRDH2 from anti-Fzd VH chain
GWMNPNSGDTGYA

SEQ ID NO: 1289 - protein, 13 aa, Artificial Sequence
  Made in Lab - CRDH2 from anti-Fzd VH chain
GIINPNSGSTSYA

SEQ ID NO: 1290 - protein, 13 aa, Artificial Sequence
  Made in Lab - CRDH2 from anti-Fzd VH chain
GIINPNGGTTSYA

SEQ ID NO: 1291 - protein, 13 aa, Artificial Sequence
  Made in Lab - CRDH2 from anti-Fzd VH chain
GIINPYGGGTSYG

SEQ ID NO: 1292 - protein, 13 aa, Artificial Sequence
  Made in Lab - CRDH2 from anti-Fzd VH chain
GWMNPNSDNTGYA

SEQ ID NO: 1293 - protein, 13 aa, Artificial Sequence
  Made in Lab - CRDH2 from anti-Fzd VH chain
GWTDPISGDTSYA

SEQ ID NO: 1294 - protein, 13 aa, Artificial Sequence
  Made in Lab - CRDH2 from anti-Fzd VH chain
GIINPSGGSTSYA

SEQ ID NO: 1295 - protein, 13 aa, Artificial Sequence
  Made in Lab - CRDH2 from anti-Fzd VH chain
GIINPSGGYTTYA

SEQ ID NO: 1296 - protein, 13 aa, Artificial Sequence
  Made in Lab - CRDH2 from anti-Fzd VH chain
GIINPSGGSTSYG

SEQ ID NO: 1297 - protein, 13 aa, Artificial Sequence
  Made in Lab - CRDH2 from anti-Fzd VH chain
GIINPSEGSTNYA

SEQ ID NO: 1298 - protein, 13 aa, Artificial Sequence
  Made in Lab - CRDH2 from anti-Fzd VH chain
GIINPNGGSTSYA

SEQ ID NO: 1299 - protein, 13 aa, Artificial Sequence
  Made in Lab - CRDH2 from anti-Fzd VH chain
GIINPRVGSTTNA

SEQ ID NO: 1300 - protein, 13 aa, Artificial Sequence
  Made in Lab - CRDH2 from anti-Fzd VH chain
GWINPNSGATTYA

SEQ ID NO: 1301 - protein, 13 aa, Artificial Sequence
  Made in Lab - CRDH2 from anti-Fzd VH chain
GWMNPNSGDTGYA

SEQ ID NO: 1302 - protein, 13 aa, Artificial Sequence
  Made in Lab - CRDH2 from anti-Fzd VH chain
GIINPTVGSTTYA

SEQ ID NO: 1303 - protein, 13 aa, Artificial Sequence
  Made in Lab - CRDH2 from anti-Fzd VH chain
GVINPSGGSTTYA

SEQ ID NO: 1304 - protein, 13 aa, Artificial Sequence
  Made in Lab - CRDH2 from anti-Fzd VH chain
GWINPNSGATTYA

SEQ ID NO: 1305 - protein, 13 aa, Artificial Sequence
  Made in Lab - CRDH2 from anti-Fzd VH chain
GWMNPYTGNTGFA

SEQ ID NO: 1306 - protein, 13 aa, Artificial Sequence
  Made in Lab - CRDH2 from anti-Fzd VH chain
GIINPRDGDTVYA

SEQ ID NO: 1307 - protein, 13 aa, Artificial Sequence
  Made in Lab - CRDH2 from anti-Fzd VH chain
GWINPNSGATTYA

SEQ ID NO: 1308 - protein, 13 aa, Artificial Sequence
  Made in Lab - CRDH2 from anti-Fzd VH chain
GWMSPNSGDTGYA

SEQ ID NO: 1309 - protein, 13 aa, Artificial Sequence
  Made in Lab - CRDH2 from anti-Fzd VH chain
GZISPYZGGTSYG

SEQ ID NO: 1310 - protein, 13 aa, Artificial Sequence
  Made in Lab - CRDH2 from anti-Fzd VH chain
GWINPNNGATNYA

SEQ ID NO: 1311 - protein, 13 aa, Artificial Sequence
  Made in Lab - CRDH2 from anti-Fzd VH chain
GIINPSSGSTTYA

SEQ ID NO: 1312 - protein, 13 aa, Artificial Sequence
  Made in Lab - CRDH2 from anti-Fzd VH chain
GIVNPSSGSTTYA

SEQ ID NO: 1313 - protein, 13 aa, Artificial Sequence
  Made in Lab - CRDH2 from anti-Fzd VH chain
GWTZPISGDTNYA

SEQ ID NO: 1314 - protein, 13 aa, Artificial Sequence
  Made in Lab - CRDH2 from anti-Fzd VH chain
GIINPYGGGTSYG

SEQ ID NO: 1315 - protein, 13 aa, Artificial Sequence
  Made in Lab - CRDH2 from anti-Fzd VH chain
SYISGDSGYTNYA

SEQ ID NO: 1316 - protein, 13 aa, Artificial Sequence
  Made in Lab - CRDH2 from anti-Fzd VH chain
GWTDHISGDTSYA

SEQ ID NO: 1317 - protein, 13 aa, Artificial Sequence
  Made in Lab - CRDH2 from anti-Fzd VH chain
GIINPSGGTTTYA

SEQ ID NO: 1318 - protein, 13 aa, Artificial Sequence
  Made in Lab - CRDH2 from anti-Fzd VH chain
GWMNPNSGNTGYA

SEQ ID NO: 1319 - protein, 13 aa, Artificial Sequence
  Made in Lab - CRDH2 from anti-Fzd VH chain
GIINPNGGTTTYA

SEQ ID NO: 1320 - protein, 13 aa, Artificial Sequence
  Made in Lab - CRDH2 from anti-Fzd VH chain
GVINPNGGSTTYA

SEQ ID NO: 1321 - protein, 13 aa, Artificial Sequence
  Made in Lab - CRDH2 from anti-Fzd VH chain
GIINPNSGGTNYA

SEQ ID NO: 1322 - protein, 13 aa, Artificial Sequence
  Made in Lab - CRDH2 from anti-Fzd VH chain
GVINPTAGDTTYA

SEQ ID NO: 1323 - protein, 13 aa, Artificial Sequence
  Made in Lab - CRDH2 from anti-Fzd VH chain
GIINPYGGGTSYG

SEQ ID NO: 1324 - protein, 13 aa, Artificial Sequence
  Made in Lab - CRDH2 from anti-Fzd VH chain
GIINPNGGZTSYA

SEQ ID NO: 1325 - protein, 13 aa, Artificial Sequence
  Made in Lab - CRDH2 from anti-Fzd VH chain
GIINPYGGGTSYG

SEQ ID NO: 1326 - protein, 13 aa, Artificial Sequence
  Made in Lab - CRDH2 from anti-Fzd VH chain
GRINPNTGGTNYA

SEQ ID NO: 1327 - protein, 13 aa, Artificial Sequence
  Made in Lab - CRDH2 from anti-Fzd VH chain
GIINPYGGGTSYG

SEQ ID NO: 1328 - protein, 13 aa, Artificial Sequence
  Made in Lab - CRDH2 from anti-Fzd VH chain
GWINLNSGGTNSG

SEQ ID NO: 1329 - protein, 13 aa, Artificial Sequence
  Made in Lab - CRDH2 from anti-Fzd VH chain
GIINPSSGNTNYA

SEQ ID NO: 1330 - protein, 13 aa, Artificial Sequence
  Made in Lab - CRDH2 from anti-Fzd VH chain
GIINPYGGGTSYG

SEQ ID NO: 1331 - protein, 13 aa, Artificial Sequence
  Made in Lab - CRDH2 from anti-Fzd VH chain
GWINPNSGGTNYA

SEQ ID NO: 1332 - protein, 13 aa, Artificial Sequence
  Made in Lab - CRDH2 from anti-Fzd VH chain
GWINPNSGATNYA

SEQ ID NO: 1333 - protein, 13 aa, Artificial Sequence
  Made in Lab - CRDH2 from anti-Fzd VH chain
GIINPZGGTTSYA

SEQ ID NO: 1334 - protein, 13 aa, Artificial Sequence
  Made in Lab - CRDH2 from anti-Fzd VH chain
GIINPYGGGTSYG

SEQ ID NO: 1335 - protein, 13 aa, Artificial Sequence
  Made in Lab - CRDH2 from anti-Fzd VH chain
GWINPNNGATNYA

SEQ ID NO: 1336 - protein, 13 aa, Artificial Sequence
  Made in Lab - CRDH2 from anti-Fzd VH chain
ZIINPSZZSTSZA

SEQ ID NO: 1337 - protein, 13 aa, Artificial Sequence
  Made in Lab - CRDH2 from anti-Fzd VH chain
GIINPSGGATIYA

SEQ ID NO: 1338 - protein, 13 aa, Artificial Sequence
  Made in Lab - CRDH2 from anti-Fzd VH chain
GRMNPNGGNTGYA

SEQ ID NO: 1339 - protein, 13 aa, Artificial Sequence
  Made in Lab - CRDH2 from anti-Fzd VH chain
GIVNPSSGSTTYA

SEQ ID NO: 1340 - protein, 13 aa, Artificial Sequence
  Made in Lab - CRDH2 from anti-Fzd VH chain
GIINPIDGGTTYA

SEQ ID NO: 1341 - protein, 13 aa, Artificial Sequence
  Made in Lab - CRDH2 from anti-Fzd VH chain
GIINPSGGSTSYA

SEQ ID NO: 1342 - protein, 13 aa, Artificial Sequence
  Made in Lab - CRDH2 from anti-Fzd VH chain
ZIINPSGGSTSYA

SEQ ID NO: 1343 - protein, 13 aa, Artificial Sequence
  Made in Lab - CRDH2 from anti-Fzd VH chain
GIINPSGGTTSYA

SEQ ID NO: 1344 - protein, 13 aa, Artificial Sequence
  Made in Lab - CRDH2 from anti-Fzd VH chain
GIINPYGGGTSYG

SEQ ID NO: 1345 - protein, 13 aa, Artificial Sequence
  Made in Lab - CRDH2 from anti-Fzd VH chain
GIINPVGGSTTYA

SEQ ID NO: 1346 - protein, 13 aa, Artificial Sequence
  Made in Lab - CRDH2 from anti-Fzd VH chain
GIINPSGGSTTYA

SEQ ID NO: 1347 - protein, 13 aa, Artificial Sequence
  Made in Lab - CRDH2 from anti-Fzd VH chain
GIINPSGGSTSYA

SEQ ID NO: 1348 - protein, 13 aa, Artificial Sequence
  Made in Lab - CRDH2 from anti-Fzd VH chain
GZINPZGGTTTYA

SEQ ID NO: 1349 - protein, 13 aa, Artificial Sequence
  Made in Lab - CRDH2 from anti-Fzd VH chain
GWISPYNGNAKYA

SEQ ID NO: 1350 - protein, 13 aa, Artificial Sequence
  Made in Lab - CRDH2 from anti-Fzd VH chain
GWINPNTGGTNYA

SEQ ID NO: 1351 - protein, 13 aa, Artificial Sequence
  Made in Lab - CRDH2 from anti-Fzd VH chain
GWMNPNSGNTGYA

SEQ ID NO: 1352 - protein, 13 aa, Artificial Sequence
  Made in Lab - CRDH2 from anti-Fzd VH chain
GWINPZRGDTMYA

SEQ ID NO: 1353 - protein, 13 aa, Artificial Sequence
  Made in Lab - CRDH2 from anti-Fzd VH chain
GIISPYGGGTSYG

SEQ ID NO: 1354 - protein, 13 aa, Artificial Sequence
  Made in Lab - CRDH2 from anti-Fzd VH chain
GWINPKRGDTMYA

SEQ ID NO: 1355 - protein, 13 aa, Artificial Sequence
  Made in Lab - CRDH2 from anti-Fzd VH chain
GVINPSGGSTSYA

SEQ ID NO: 1356 - protein, 13 aa, Artificial Sequence
  Made in Lab - CRDH2 from anti-Fzd VH chain
GIINPSGGSTSYA

SEQ ID NO: 1357 - protein, 13 aa, Artificial Sequence
  Made in Lab - CRDH2 from anti-Fzd VH chain
GIINPSIGSTTYA

SEQ ID NO: 1358 - protein, 13 aa, Artificial Sequence
  Made in Lab - CRDH2 from anti-Fzd VH chain
GWMSPNSGATNYA

SEQ ID NO: 1359 - protein, 13 aa, Artificial Sequence
  Made in Lab - CRDH2 from anti-Fzd VH chain
GIINPSGGSTSYA

SEQ ID NO: 1360 - protein, 13 aa, Artificial Sequence
  Made in Lab - CRDH2 from anti-Fzd VH chain
GIINPSDGSTTYA

SEQ ID NO: 1361 - protein, 13 aa, Artificial Sequence
  Made in Lab - CRDH2 from anti-Fzd VH chain
GWINPNSGNTGYA

SEQ ID NO: 1362 - protein, 13 aa, Artificial Sequence
  Made in Lab - CRDH2 from anti-Fzd VH chain
GRIIPILGIANYA

SEQ ID NO: 1363 - protein, 13 aa, Artificial Sequence
  Made in Lab - CRDH2 from anti-Fzd VH chain
GWINPNSGGTNYA

SEQ ID NO: 1364 - protein, 13 aa, Artificial Sequence
  Made in Lab - CRDH2 from anti-Fzd VH chain
GWVNPNIGGTNYE

SEQ ID NO: 1365 - protein, 13 aa, Artificial Sequence
  Made in Lab - CRDH2 from anti-Fzd VH chain
ALISYSGSEKYYA

SEQ ID NO: 1366 - protein, 13 aa, Artificial Sequence
  Made in Lab - CRDH2 from anti-Fzd VH chain
GWMNPNSGYTGYA

SEQ ID NO: 1367 - protein, 13 aa, Artificial Sequence
  Made in Lab - CRDH2 from anti-Fzd VH chain
GRISPHDGGTIYA

SEQ ID NO: 1368 - protein, 13 aa, Artificial Sequence
  Made in Lab - CRDH2 from anti-Fzd VH chain
GGIIPIFGTANYA

SEQ ID NO: 1369 - protein, 12 aa, Artificial Sequence
  Made in Lab - CRDH2 from anti-Fzd VH chain
SAIGAGGGTYYA

SEQ ID NO: 1370 - protein, 13 aa, Artificial Sequence
  Made in Lab - CRDH2 from anti-Fzd VH chain
SAISSSGTDIYYA

SEQ ID NO: 1371 - protein, 13 aa, Artificial Sequence
  Made in Lab - CRDH2 from anti-Fzd VH chain
SGISGSGYTTYYA

SEQ ID NO: 1372 - protein, 13 aa, Artificial Sequence
  Made in Lab - CRDH2 from anti-Fzd VH chain
SGISWNSGSIGYA

SEQ ID NO: 1373 - protein, 13 aa, Artificial Sequence
  Made in Lab - CRDH2 from anti-Fzd VH chain
GVINPISGTVTYA

SEQ ID NO: 1374 - protein, 13 aa, Artificial Sequence
  Made in Lab - CRDH2 from anti-Fzd VH chain
GWINPNSGGTHYA

SEQ ID NO: 1375 - protein, 13 aa, Artificial Sequence
  Made in Lab - CRDH2 from anti-Fzd VH chain
SDVSGSGGGTYYA

SEQ ID NO: 1376 - protein, 13 aa, Artificial Sequence
  Made in Lab - CRDH2 from anti-Fzd VH chain
SVISWDGSIQYYA

SEQ ID NO: 1377 - protein, 13 aa, Artificial Sequence
  Made in Lab - CRDH2 from anti-Fzd VH chain
GWMNPNNGDTNYA

SEQ ID NO: 1378 - protein, 13 aa, Artificial Sequence
  Made in Lab - CRDH2 from anti-Fzd VH chain
SAISGSGGSTYYA

SEQ ID NO: 1379 - protein, 13 aa, Artificial Sequence
  Made in Lab - CRDH2 from anti-Fzd VH chain
GIINPNSGGTNYA

SEQ ID NO: 1380 - protein, 13 aa, Artificial Sequence
  Made in Lab - CRDH2 from anti-Fzd VH chain
AVMSYDGRHEYYA

SEQ ID NO: 1381 - protein, 13 aa, Artificial Sequence
  Made in Lab - CRDH2 from anti-Fzd VH chain
AVMSYDGRHEYYA

SEQ ID NO: 1382 - protein, 13 aa, Artificial Sequence
  Made in Lab - CRDH2 from anti-Fzd VH chain
GIINPSGGSTSYA

SEQ ID NO: 1383 - protein, 13 aa, Artificial Sequence
  Made in Lab - CRDH2 from anti-Fzd VH chain
GGIIPMFGQTNYA

SEQ ID NO: 1384 - protein, 13 aa, Artificial Sequence
  Made in Lab - CRDH2 from anti-Fzd VH chain
GWINPNSGNRGYA

SEQ ID NO: 1385 - protein, 13 aa, Artificial Sequence
  Made in Lab - CRDH2 from anti-Fzd VH chain
GWMNPNSGNTGYA

SEQ ID NO: 1386 - protein, 12 aa, Artificial Sequence
  Made in Lab - CRDH2 from anti-Fzd VH chain
SAIGTGGGTYYA

SEQ ID NO: 1387 - protein, 13 aa, Artificial Sequence
  Made in Lab - CRDH2 from anti-Fzd VH chain
GIIRTGNGNTAYA

SEQ ID NO: 1388 - protein, 13 aa, Artificial Sequence
  Made in Lab - CRDH2 from anti-Fzd VH chain
GVINLSGGTTSYA

SEQ ID NO: 1389 - protein, 13 aa, Artificial Sequence
  Made in Lab - CRDH2 from anti-Fzd VH chain
GIINPSGGSTSYA

SEQ ID NO: 1390 - protein, 13 aa, Artificial Sequence
  Made in Lab - CRDH2 from anti-Fzd VH chain
GWMNPNSGNTGYA

SEQ ID NO: 1391 - protein, 13 aa, Artificial Sequence
  Made in Lab - CRDH2 from anti-Fzd VH chain
GWMNRNSGNTGYA

SEQ ID NO: 1392 - protein, 13 aa, Artificial Sequence
  Made in Lab - CRDH2 from anti-Fzd VH chain
SAISGSGGSTYYA

SEQ ID NO: 1393 - protein, 13 aa, Artificial Sequence
  Made in Lab - CRDH2 from anti-Fzd VH chain
GWINPNSGGTDYA

SEQ ID NO: 1394 - protein, 15 aa, Artificial Sequence
  Made in Lab - CRDH2 from anti-Fzd VH chain
GFIRSKAYGGTTEYA

SEQ ID NO: 1395 - protein, 13 aa, Artificial Sequence
  Made in Lab - CRDH2 from anti-Fzd VH chain
GVIYPGDSDTRYS

SEQ ID NO: 1396 - protein, 13 aa, Artificial Sequence
  Made in Lab - CRDH2 from anti-Fzd VH chain
GGIIPVFGTPNYA

SEQ ID NO: 1397 - protein, 12 aa, Artificial Sequence
  Made in Lab - CRDH2 from anti-Fzd VH chain
SAIGTGGGTYYA

SEQ ID NO: 1398 - protein, 13 aa, Artificial Sequence
  Made in Lab - CRDH2 from anti-Fzd VH chain
AVLSYDARNTYYA

SEQ ID NO: 1399 - protein, 12 aa, Artificial Sequence
  Made in Lab - CRDH2 from anti-Fzd VH chain
SAIGTGGGTYYA

SEQ ID NO: 1400 - protein, 13 aa, Artificial Sequence
  Made in Lab - CRDH2 from anti-Fzd VH chain
GWMNPNSGDTGYA

SEQ ID NO: 1401 - protein, 12 aa, Artificial Sequence
  Made in Lab - CRDH2 from anti-Fzd VH chain
SAIGTGGGTYYA

SEQ ID NO: 1402 - protein, 13 aa, Artificial Sequence
  Made in Lab - CRDH2 from anti-Fzd VH chain
SGLSGSGDTSYYA

SEQ ID NO: 1403 - protein, 13 aa, Artificial Sequence
  Made in Lab - CRDH2 from anti-Fzd VH chain
GIINPSGGSTSFA

SEQ ID NO: 1404 - protein, 13 aa, Artificial Sequence
  Made in Lab - CRDH2 from anti-Fzd VH chain
GMINPSGGSTNYA

SEQ ID NO: 1405 - protein, 13 aa, Artificial Sequence
  Made in Lab - CRDH2 from anti-Fzd VH chain
AVISYDGSNKYYA

SEQ ID NO: 1406 - protein, 13 aa, Artificial Sequence
  Made in Lab - CRDH2 from anti-Fzd VH chain
GWMNPNSGGTNYA

SEQ ID NO: 1407 - protein, 13 aa, Artificial Sequence
  Made in Lab - CRDH2 from anti-Fzd VH chain
SAMSGSGSYKYYA

SEQ ID NO: 1408 - protein, 13 aa, Artificial Sequence
  Made in Lab - CRDH2 from anti-Fzd VH chain
GWVNPTSGNTGYA

SEQ ID NO: 1409 - protein, 13 aa, Artificial Sequence
  Made in Lab - CRDH2 from anti-Fzd VH chain
GMINPNGGGTTYT

SEQ ID NO: 1410 - protein, 13 aa, Artificial Sequence
  Made in Lab - CRDH2 from anti-Fzd VH chain
AVISYDGSNKYYA

SEQ ID NO: 1411 - protein, 13 aa, Artificial Sequence
  Made in Lab - CRDH2 from anti-Fzd VH chain
SSISSSSSYIYYA

SEQ ID NO: 1412 - protein, 13 aa, Artificial Sequence
  Made in Lab - CRDH2 from anti-Fzd VH chain
SAISGSGGSTYYA

SEQ ID NO: 1413 - protein, 15 aa, Artificial Sequence
  Made in Lab - CRDH2 from anti-Fzd VH chain
GFIRSKAYGGTTEYA

SEQ ID NO: 1414 - protein, 13 aa, Artificial Sequence
  Made in Lab - CRDH2 from anti-Fzd VH chain
GIINPSGGSTSYA

SEQ ID NO: 1415 - protein, 12 aa, Artificial Sequence
  Made in Lab - CRDH2 from anti-Fzd VH chain
STISSDGRTYYA

SEQ ID NO: 1416 - protein, 12 aa, Artificial Sequence
  Made in Lab - CRDH2 from anti-Fzd VH chain
SAIGTGGGTYYA

SEQ ID NO: 1417 - protein, 13 aa, Artificial Sequence
  Made in Lab - CRDH2 from anti-Fzd VH chain
SVISTSGDTVLYT

SEQ ID NO: 1418 - protein, 13 aa, Artificial Sequence
  Made in Lab - CRDH2 from anti-Fzd VH chain
TLMSSDGNEEYYA

SEQ ID NO: 1419 - protein, 13 aa, Artificial Sequence
  Made in Lab - CRDH2 from anti-Fzd VH chain
GWMNPNSGNTGYA

SEQ ID NO: 1420 - protein, 13 aa, Artificial Sequence
  Made in Lab - CRDH2 from anti-Fzd VH chain
GWVNPNSGNTGYA

SEQ ID NO: 1421 - protein, 13 aa, Artificial Sequence
  Made in Lab - CRDH2 from anti-Fzd VH chain
GWMNPNSGGTNYA

SEQ ID NO: 1422 - protein, 12 aa, Artificial Sequence
  Made in Lab - CRDH2 from anti-Fzd VH chain
SAIGTIDDTYYS

SEQ ID NO: 1423 - protein, 13 aa, Artificial Sequence
  Made in Lab - CRDH2 from anti-Fzd VH chain
SGISANGATTYYA

SEQ ID NO: 1424 - protein, 14 aa, Artificial Sequence
  Made in Lab - CRDH2 from anti-Fzd VH chain
GRTYFRSKWYTEYA

SEQ ID NO: 1425 - protein, 13 aa, Artificial Sequence
  Made in Lab - CRDH2 from anti-Fzd VH chain
AAISYDGSNKYFA

SEQ ID NO: 1426 - protein, 11 aa, Artificial Sequence
  Made in Lab - CRDH3 from anti-Fzd VH chain
CARGGGVFDYW

SEQ ID NO: 1427 - protein, 12 aa, Artificial Sequence
  Made in Lab - CRDH3 from anti-Fzd VH chain
CARHGHWYFDLW

SEQ ID NO: 1428 - protein, 19 aa, Artificial Sequence
  Made in Lab - CRDH3 from anti-Fzd VH chain
CARRRPIVNWNDLDAFDIW

SEQ ID NO: 1429 - protein, 19 aa, Artificial Sequence
  Made in Lab - CRDH3 from anti-Fzd VH chain
CAREGEYCSSTSCAREEVW

SEQ ID NO: 1430 - protein, 17 aa, Artificial Sequence
  Made in Lab - CRDH3 from anti-Fzd VH chain
CARREYSGYDHDAFDIW

SEQ ID NO: 1431 - protein, 20 aa, Artificial Sequence
  Made in Lab - CRDH3 from anti-Fzd VH chain
CARGGYSSSWYPAAEYFQHW

SEQ ID NO: 1432 - protein, 21 aa, Artificial Sequence
  Made in Lab - CRDH3 from anti-Fzd VH chain
CARRDIVVVPAAKMEGAFDIW

SEQ ID NO: 1433 - protein, 18 aa, Artificial Sequence
  Made in Lab - CRDH3 from anti-Fzd VH chain
CASRAIFGVVENYYMDVW

SEQ ID NO: 1434 - protein, 12 aa, Artificial Sequence
  Made in Lab - CRDH3 from anti-Fzd VH chain
CARVLYDGMDVW

SEQ ID NO: 1435 - protein, 13 aa, Artificial Sequence
  Made in Lab - CRDH3 from anti-Fzd VH chain
CARRAVAGIFDYW

SEQ ID NO: 1436 - protein, 17 aa, Artificial Sequence
  Made in Lab - CRDH3 from anti-Fzd VH chain
CARRIVVVTGDHAFDIW

SEQ ID NO: 1437 - protein, 14 aa, Artificial Sequence
  Made in Lab - CRDH3 from anti-Fzd VH chain
CARRMVYAPYKDVW

SEQ ID NO: 1438 - protein, 14 aa, Artificial Sequence
  Made in Lab - CRDH3 from anti-Fzd VH chain
CAIRTIFGVVIDYW

SEQ ID NO: 1439 - protein, 18 aa, Artificial Sequence
  Made in Lab - CRDH3 from anti-Fzd VH chain
CARRIDSSGYSSRYFDLW

SEQ ID NO: 1440 - protein, 14 aa, Artificial Sequence
  Made in Lab - CRDH3 from anti-Fzd VH chain
CARRSSGWYEVDYW

SEQ ID NO: 1441 - protein, 20 aa, Artificial Sequence
  Made in Lab - CRDH3 from anti-Fzd VH chain
CAREVATISSDDAQYYFDYW

SEQ ID NO: 1442 - protein, 19 aa, Artificial Sequence
  Made in Lab - CRDH3 from anti-Fzd VH chain
CARRPLWWHVAGVYYMDVW

SEQ ID NO: 1443 - protein, 16 aa, Artificial Sequence
  Made in Lab - CRDH3 from anti-Fzd VH chain
CARRSVAAGTPFTDYW

SEQ ID NO: 1444 - protein, 16 aa, Artificial Sequence
  Made in Lab - CRDH3 from anti-Fzd VH chain
CARRSMIAATDAFDMW

SEQ ID NO: 1445 - protein, 19 aa, Artificial Sequence
  Made in Lab - CRDH3 from anti-Fzd VH chain
CARRSKYSSSSGNEYFDLW

SEQ ID NO: 1446 - protein, 11 aa, Artificial Sequence
  Made in Lab - CRDH3 from anti-Fzd VH chain
CARAFNGMDVW

SEQ ID NO: 1447 - protein, 17 aa, Artificial Sequence
  Made in Lab - CRDH3 from anti-Fzd VH chain
CAARRRWEPRRRDFDLW

SEQ ID NO: 1448 - protein, 16 aa, Artificial Sequence
  Made in Lab - CRDH3 from anti-Fzd VH chain
CTARDPTFRGPGMDVW

SEQ ID NO: 1449 - protein, 16 aa, Artificial Sequence
  Made in Lab - CRDH3 from anti-Fzd VH chain
CASTGTTVTTRGNDYW

SEQ ID NO: 1450 - protein, 16 aa, Artificial Sequence
  Made in Lab - CRDH3 from anti-Fzd VH chain
CARASWFGEGRQNDPW

SEQ ID NO: 1451 - protein, 16 aa, Artificial Sequence
  Made in Lab - CRDH3 from anti-Fzd VH chain
CARGSGWKHAEYFQHW

SEQ ID NO: 1452 - protein, 16 aa, Artificial Sequence
  Made in Lab - CRDH3 from anti-Fzd VH chain
CARASGFGEGQHFHPW

SEQ ID NO: 1453 - protein, 14 aa, Artificial Sequence
  Made in Lab - CRDH3 from anti-Fzd VH chain
CARGVEPYYGMDVW

SEQ ID NO: 1454 - protein, 17 aa, Artificial Sequence
  Made in Lab - CRDH3 from anti-Fzd VH chain
CARRRIAAAGVDAFDIW

SEQ ID NO: 1455 - protein, 18 aa, Artificial Sequence
  Made in Lab - CRDH3 from anti-Fzd VH chain
CARRRVAAHSTHDAFDIW

SEQ ID NO: 1456 - protein, 16 aa, Artificial Sequence
  Made in Lab - CRDH3 from anti-Fzd VH chain
CARDLRSGYSYAWSPW

SEQ ID NO: 1457 - protein, 11 aa, Artificial Sequence
  Made in Lab - CRDH3 from anti-Fzd VH chain
CARFYTAGDYW

SEQ ID NO: 1458 - protein, 15 aa, Artificial Sequence
  Made in Lab - CRDH3 from anti-Fzd VH chain
CARRAYSSRDGMDVW

SEQ ID NO: 1459 - protein, 13 aa, Artificial Sequence
  Made in Lab - CRDH3 from anti-Fzd VH chain
CARARGYRAFDIW

SEQ ID NO: 1460 - protein, 14 aa, Artificial Sequence
  Made in Lab - CRDH3 from anti-Fzd VH chain
CARDGQQLEAFQHW

SEQ ID NO: 1461 - protein, 19 aa, Artificial Sequence
  Made in Lab - CRDH3 from anti-Fzd VH chain
CARRAYSSSWYGYDAFDIW

SEQ ID NO: 1462 - protein, 17 aa, Artificial Sequence
  Made in Lab - CRDH3 from anti-Fzd VH chain
CARDDVDSNYVGGMDVW

SEQ ID NO: 1463 - protein, 18 aa, Artificial Sequence
  Made in Lab - CRDH3 from anti-Fzd VH chain
CARDTGTTRTYYYGMDVW

SEQ ID NO: 1464 - protein, 11 aa, Artificial Sequence [sequence omitted]

SEQ ID NO: 1465 - protein, 20 aa, Artificial Sequence
  Made in Lab - CRDH3 from anti-Fzd VH chain
CARDTGPKSYSSNAYGMDVW

SEQ ID NO: 1466 - protein, 15 aa, Artificial Sequence
  Made in Lab - CRDH3 from anti-Fzd VH chain
CARDSGSNGYSFDIW

SEQ ID NO: 1467 - protein, 14 aa, Artificial Sequence
  Made in Lab - CRDH3 from anti-Fzd VH chain
CAKSRAAHGYFDYW

SEQ ID NO: 1468 - protein, 16 aa, Artificial Sequence
  Made in Lab - CRDH3 from anti-Fzd VH chain
CARAGGSVENLGGDYW

SEQ ID NO: 1469 - protein, 14 aa, Artificial Sequence
  Made in Lab - CRDH3 from anti-Fzd VH chain
CARYSSSWYAFDIW

SEQ ID NO: 1470 - protein, 15 aa, Artificial Sequence
  Made in Lab - CRDH3 from anti-Fzd VH chain
CARDYGDYTQSNDYW

SEQ ID NO: 1471 - protein, 12 aa, Artificial Sequence
  Made in Lab - CRDH3 from anti-Fzd VH chain
CVRDTNWAFDLW

SEQ ID NO: 1472 - protein, 16 aa, Artificial Sequence
  Made in Lab - CRDH3 from anti-Fzd VH chain
CARDGKSIAVAGLDYW

SEQ ID NO: 1473 - protein, 14 aa, Artificial Sequence
  Made in Lab - CRDH3 from anti-Fzd VH chain
CAREGRLSYGMDVW

SEQ ID NO: 1474 - protein, 9 aa, Artificial Sequence [sequence omitted]

SEQ ID NO: 1475 - protein, 15 aa, Artificial Sequence
  Made in Lab - CRDH3 from anti-Fzd VH chain
CARERAGVLSYFDLW

SEQ ID NO: 1476 - protein, 12 aa, Artificial Sequence
  Made in Lab - CRDH3 from anti-Fzd VH chain
CARDTDVALDYW

SEQ ID NO: 1477 - protein, 12 aa, Artificial Sequence
  Made in Lab - CRDH3 from anti-Fzd VH chain
CARDTDVALDYW

SEQ ID NO: 1478 - protein, 12 aa, Artificial Sequence [sequence omitted]

SEQ ID NO: 1479 - protein, 11 aa, Artificial Sequence
  Made in Lab - CRDH3 from anti-Fzd VH chain
CARDWDLLDYW

SEQ ID NO: 1480 - protein, 22 aa, Artificial Sequence
  Made in Lab - CRDH3 from anti-Fzd VH chain
CAREPLWFGESSPHDYYGMDVW

SEQ ID NO: 1481 - protein, 13 aa, Artificial Sequence
  Made in Lab - CRDH3 from anti-Fzd VH chain
CARDSLRLGFDYW

SEQ ID NO: 1482 - protein, 20 aa, Artificial Sequence
  Made in Lab - CRDH3 from anti-Fzd VH chain
CARGMYDYVWGRYPKGFDPW

SEQ ID NO: 1483 - protein, 12 aa, Artificial Sequence [sequence omitted]

SEQ ID NO: 1484 - protein, 15 aa, Artificial Sequence
  Made in Lab - CRDH3 from anti-Fzd VH chain
CARERAGVLSYFDLW

SEQ ID NO: 1485 - protein, 20 aa, Artificial Sequence
  Made in Lab - CRDH3 from anti-Fzd VH chain
CNTVPPTTYHSGTFFPEGYW

SEQ ID NO: 1486 - protein, 9 aa, Artificial Sequence [sequence omitted]

SEQ ID NO: 1487 - protein, 12 aa, Artificial Sequence
  Made in Lab - CRDH3 from anti-Fzd VH chain
CATDNERAFDIW

SEQ ID NO: 1488 - protein, 12 aa, Artificial Sequence
  Made in Lab - CRDH3 from anti-Fzd VH chain
CAKENSYGMDVW

SEQ ID NO: 1489 - protein, 19 aa, Artificial Sequence
  Made in Lab - CRDH3 from anti-Fzd VH chain
CARDSAGTTGYYYYGMDVW

SEQ ID NO: 1490 - protein, 16 aa, Artificial Sequence
  Made in Lab - CRDH3 from anti-Fzd VH chain
CARAHWNYQGDAFDIW

SEQ ID NO: 1491 - protein, 9 aa, Artificial Sequence [sequence omitted]

SEQ ID NO: 1492 - protein, 18 aa, Artificial Sequence
  Made in Lab - CRDH3 from anti-Fzd VH chain
CARRRVAAHSTHDAFDIW

SEQ ID NO: 1493 - protein, 16 aa, Artificial Sequence
  Made in Lab - CRDH3 from anti-Fzd VH chain
CAREKLGLGSGYFDYW

SEQ ID NO: 1494 - protein, 14 aa, Artificial Sequence
  Made in Lab - CRDH3 from anti-Fzd VH chain
CARDQEDYYGMDVW

SEQ ID NO: 1495 - protein, 15 aa, Artificial Sequence
  Made in Lab - CRDH3 from anti-Fzd VH chain
CARNYYGSGSYIDYW

SEQ ID NO: 1496 - protein, 16 aa, Artificial Sequence
  Made in Lab - CRDH3 from anti-Fzd VH chain
CARDTDQWEHGYFDLW

SEQ ID NO: 1497 - protein, 22 aa, Artificial Sequence
  Made in Lab - CRDH3 from anti-Fzd VH chain
CARELGSGSYLSGYYYYGMDVW

SEQ ID NO: 1498 - protein, 16 aa, Artificial Sequence
  Made in Lab - CRDH3 from anti-Fzd VH chain
CAREALRHYYYGMDVW

SEQ ID NO: 1499 - protein, 18 aa, Artificial Sequence
  Made in Lab - CRDH3 from anti-Fzd VH chain
CARENVNSGFYYYGMDVW

SEQ ID NO: 1500 - protein, 18 aa, Artificial Sequence
  Made in Lab - CRDH3 from anti-Fzd VH chain
CARETVSSGYYYYGMDVW

SEQ ID NO: 1501 - protein, 9 aa, Artificial Sequence [sequence omitted]

SEQ ID NO: 1502 - protein, 13 aa, Artificial Sequence
  Made in Lab - CRDH3 from anti-Fzd VH chain
CARDTAVAGIDYW

SEQ ID NO: 1503 - protein, 14 aa, Artificial Sequence
  Made in Lab - CRDH3 from anti-Fzd VH chain
CARDQEDYYGMDVW

SEQ ID NO: 1504 - protein, 13 aa, Artificial Sequence
  Made in Lab - CRDH3 from anti-Fzd VH chain
CARSYGDYGFDYW

SEQ ID NO: 1505 - protein, 17 aa, Artificial Sequence
  Made in Lab - CRDH3 from anti-Fzd VH chain
CASEYSSPRGGVGMDVW

SEQ ID NO: 1506 - protein, 19 aa, Artificial Sequence
  Made in Lab - CRDH3 from anti-Fzd VH chain
CARRQYCSSTSCYYGMDVW

SEQ ID NO: 1507 - protein, 14 aa, Artificial Sequence
  Made in Lab - CRDH3 from anti-Fzd VH chain
CAREGRLSYGMDVW

SEQ ID NO: 1508 - protein, 12 aa, Artificial Sequence
  Made in Lab - CRDH3 from anti-Fzd VH chain
CARDTDVALDYW

SEQ ID NO: 1509 - protein, 19 aa, Artificial Sequence
  Made in Lab - CRDH3 from anti-Fzd VH chain
CAREKVTPHYYYYYGMDVW

SEQ ID NO: 1510 - protein, 15 aa, Artificial Sequence
  Made in Lab - CRDH3 from anti-Fzd VH chain
CAREDSSSWYAFDYW

SEQ ID NO: 1511 - protein, 12 aa, Artificial Sequence [sequence omitted]

SEQ ID NO: 1512 - protein, 16 aa, Artificial Sequence
  Made in Lab - CRDH3 from anti-Fzd VH chain
CARLPTNDYGDYVDYW

SEQ ID NO: 1513 - protein, 7 aa, Artificial Sequence [sequence omitted]

SEQ ID NO: 1514 - protein, 7 aa, Artificial Sequence
  Made in Lab - CRDH3 from anti-Fzd VH chain
CASQDVW

SEQ ID NO: 1515 - protein, 13 aa, Artificial Sequence
  Made in Lab - CRDH3 from anti-Fzd VH chain
CAKASGGAVLDYW

SEQ ID NO: 1516 - protein, 23 aa, Artificial Sequence
  Made in Lab - CRDH3 from anti-Fzd VH chain
CAREEGLWFRELSYYYYYGMDVW

SEQ ID NO: 1517 - protein, 13 aa, Artificial Sequence
  Made in Lab - CRDH3 from anti-Fzd VH chain
CASSRRHYGMDVW

SEQ ID NO: 1518 - protein, 20 aa, Artificial Sequence
  Made in Lab - CRDH3 from anti-Fzd VH chain
CARGPLCSGGSCYYYGMDVW

SEQ ID NO: 1519 - protein, 20 aa, Artificial Sequence
  Made in Lab - CRDH3 from anti-Fzd VH chain
CARDGGYDALVGYYYGMDVW

SEQ ID NO: 1520 - protein, 7 aa, Artificial Sequence
  Made in Lab - CRDH3 from anti-Fzd VH chain
CAARGYW

SEQ ID NO: 1521 - protein, 14 aa, Artificial Sequence
  Made in Lab - CRDH3 from anti-Fzd VH chain
CAKQPYRGSGMDVW

SEQ ID NO: 1522 - protein, 21 aa, Artificial Sequence
  Made in Lab - CRDH3 from anti-Fzd VH chain
CATDSLLAAAGTDYYYGMDVW

SEQ ID NO: 1523 - protein, 13 aa, Artificial Sequence
  Made in Lab - CRDH3 from anti-Fzd VH chain
CARGPWLHGFDYW

SEQ ID NO: 1524 - protein, 18 aa, Artificial Sequence
  Made in Lab - CRDH3 from anti-Fzd VH chain
CARGPLIRFHYYYGMDVW

SEQ ID NO: 1525 - protein, 13 aa, Artificial Sequence
  Made in Lab - CRDH3 from anti-Fzd VH chain
CASTTTVASMDVW

SEQ ID NO: 1526 - protein, 18 aa, Artificial Sequence
  Made in Lab - CRDH3 from anti-Fzd VH chain
CARVIYRENSGWSDFDYW

SEQ ID NO: 1527 - protein, 13 aa, Artificial Sequence
  Made in Lab - CRDH3 from anti-Fzd VH chain
CARDLGGYGMDVW

SEQ ID NO: 1528 - protein, 7 aa, Artificial Sequence
  Made in Lab - CRDH3 from anti-Fzd VH chain
CATRQAW

SEQ ID NO: 1529 - protein, 8 aa, Artificial Sequence
  Made in Lab - CRDH3 from anti-Fzd VH chain
CRGRFDPW

SEQ ID NO: 1530 - protein, 13 aa, Artificial Sequence
  Made in Lab - CRDH3 from anti-Fzd VH chain
CARDRTRYGMDVW

SEQ ID NO: 1531 - protein, 21 aa, Artificial Sequence
  Made in Lab - CRDH3 from anti-Fzd VH chain
CARDRVVPAATYYYYYYMDVW

SEQ ID NO: 1532 - protein, 17 aa, Artificial Sequence
  Made in Lab - CRDH3 from anti-Fzd VH chain
CARVKGGSGWKRYFDLW

SEQ ID NO: 1533 - protein, 21 aa, Artificial Sequence
  Made in Lab - CRDH3 from anti-Fzd VH chain
CARDWYGSGSYYSGDYYMDVW

SEQ ID NO: 1534 - protein, 18 aa, Artificial Sequence
  Made in Lab - CRDH3 from anti-Fzd VH chain
CAREGYDILTGPGGMDVW

SEQ ID NO: 1535 - protein, 9 aa, Artificial Sequence
  Made in Lab - CRDH3 from anti-Fzd VH chain
CARGQSGIW

SEQ ID NO: 1536 - protein, 17 aa, Artificial Sequence
  Made in Lab - CRDH3 from anti-Fzd VH chain
CARTLYSSGWARYFDLW

SEQ ID NO: 1537 - protein, 14 aa, Artificial Sequence
  Made in Lab - CRDH3 from anti-Fzd VH chain
CARTPRVAGTFDYW

SEQ ID NO: 1538 - protein, 16 aa, Artificial Sequence
  Made in Lab - CRDH3 from anti-Fzd VH chain
CASSSYSSGWYPIQHW

SEQ ID NO: 1539 - protein, 16 aa, Artificial Sequence
  Made in Lab - CRDH3 from anti-Fzd VH chain
CARSRGVLWARGIDYW

SEQ ID NO: 1540 - protein, 10 aa, Artificial Sequence
  Made in Lab - CRDH3 from anti-Fzd VH chain
CARDLIMDVW

SEQ ID NO: 1541 - protein, 11 aa, Artificial Sequence
  Made in Lab - CRDH3 from anti-Fzd VH chain
CARENYGMDVW

SEQ ID NO: 1542 - protein, 15 aa, Artificial Sequence
  Made in Lab - CRDH3 from anti-Fzd VH chain
CASRGTGYSSSFDYW

SEQ ID NO: 1543 - protein, 17 aa, Artificial Sequence
  Made in Lab - CRDH3 from anti-Fzd VH chain
CARGRVATEKHWYFDLW

SEQ ID NO: 1544 - protein, 7 aa, Artificial Sequence [sequence omitted]

SEQ ID NO: 1545 - protein, 16 aa, Artificial Sequence
  Made in Lab - CRDH3 from anti-Fzd VH chain
CARSRDYGGNSAVGYW

SEQ ID NO: 1546 - protein, 22 aa, Artificial Sequence
  Made in Lab - CRDH3 from anti-Fzd VH chain
CARGRGNRGYSYGYEAVADDYW

SEQ ID NO: 1547 - protein, 16 aa, Artificial Sequence
  Made in Lab - CRDH3 from anti-Fzd VH chain
CARESGYDPYYGMDVW

SEQ ID NO: 1548 - protein, 20 aa, Artificial Sequence
  Made in Lab - CRDH3 from anti-Fzd VH chain
CARHLNLAARREGFWYFDLW

SEQ ID NO: 1549 - protein, 10 aa, Artificial Sequence
  Made in Lab - CRDH3 from anti-Fzd VH chain
CATGRVRDYW

SEQ ID NO: 1550 - protein, 11 aa, Artificial Sequence
  Made in Lab - CRDH3 from anti-Fzd VH chain
CAGGSYSYDYW

SEQ ID NO: 1551 - protein, 9 aa, Artificial Sequence
  Made in Lab - CRDH3 from anti-Fzd VH chain
CARGQSGIW

SEQ ID NO: 1552 - protein, 13 aa, Artificial Sequence
  Made in Lab - CRDH3 from anti-Fzd VH chain
CARLDYYYGMDVW

SEQ ID NO: 1553 - protein, 13 aa, Artificial Sequence
  Made in Lab - CRDH3 from anti-Fzd VH chain
CARSHSSSLLDYW

SEQ ID NO: 1554 - protein, 13 aa, Artificial Sequence [sequence omitted]

SEQ ID NO: 1555 - protein, 13 aa, Artificial Sequence
  Made in Lab - CRDH3 from anti-Fzd VH chain
CARGGYNSPLRYW

SEQ ID NO: 1556 - protein, 8 aa, Artificial Sequence
  Made in Lab - CRDH3 from anti-Fzd VH chain
CARGKDVW

SEQ ID NO: 1557 - protein, 13 aa, Artificial Sequence
  Made in Lab - CRDH3 from anti-Fzd VH chain
CAKAGYTAVLDLW

SEQ ID NO: 1558 - protein, 7 aa, Artificial Sequence
  Made in Lab - CRDH3 from anti-Fzd VH chain
CARGLSW

SEQ ID NO: 1559 - protein, 16 aa, Artificial Sequence
  Made in Lab - CRDH3 from anti-Fzd VH chain
CAKDGTGKGVSPLGYW

SEQ ID NO: 1560 - protein, 14 aa, Artificial Sequence
  Made in Lab - CRDH3 from anti-Fzd VH chain
CARARGNVGYFDYW

SEQ ID NO: 1561 - protein, 18 aa, Artificial Sequence
  Made in Lab - CRDH3 from anti-Fzd VH chain
CARGGGYSSSSSEGMDVW

SEQ ID NO: 1562 - protein, 21 aa, Artificial Sequence
  Made in Lab - CRDH3 from anti-Fzd VH chain
CAREVRHSSSYYYYYYGMDVW

SEQ ID NO: 1563 - protein, 13 aa, Artificial Sequence
  Made in Lab - CRDH3 from anti-Fzd VH chain
CARDLGGYGMDVW

SEQ ID NO: 1564 - protein, 13 aa, Artificial Sequence
  Made in Lab - CRDH3 from anti-Fzd VH chain
CAVLAPHVGFDPW

SEQ ID NO: 1565 - protein, 14 aa, Artificial Sequence
  Made in Lab - CRDH3 from anti-Fzd VH chain
CAKDRYDYAFFDYW

SEQ ID NO: 1566 - protein, 7 aa, Artificial Sequence [sequence omitted]

SEQ ID NO: 1567 - protein, 13 aa, Artificial Sequence
  Made in Lab - CRDH3 from anti-Fzd VH chain
CARDGGGYGMDVW

SEQ ID NO: 1568 - protein, 13 aa, Artificial Sequence
  Made in Lab - CRDH3 from anti-Fzd VH chain
CARDQGGYGMDVW

SEQ ID NO: 1569 - protein, 13 aa, Artificial Sequence
  Made in Lab - CRDH3 from anti-Fzd VH chain
CARLSSGYDFDYW

SEQ ID NO: 1570 - protein, 22 aa, Artificial Sequence
  Made in Lab - CRDH3 from anti-Fzd VH chain
CARFKGIAAAGKYYYYYGMDVW

SEQ ID NO: 1571 - protein, 16 aa, Artificial Sequence
  Made in Lab - CRDH3 from anti-Fzd VH chain
CARVPPAVAGQPIDYW

SEQ ID NO: 1572 - protein, 16 aa, Artificial Sequence
  Made in Lab - CRDH3 from anti-Fzd VH chain
CANLGYSSGTYYFDYW

SEQ ID NO: 1573 - protein, 12 aa, Artificial Sequence
  Made in Lab - CRDH3 from anti-Fzd VH chain
CARDDGGGMDVW

SEQ ID NO: 1574 - protein, 13 aa, Artificial Sequence
  Made in Lab - CRDH3 from anti-Fzd VH chain
CARAKYYYDMDVW

SEQ ID NO: 1575 - protein, 11 aa, Artificial Sequence [sequence omitted]

SEQ ID NO: 1576 - protein, 12 aa, Artificial Sequence
  Made in Lab - CRDH3 from anti-Fzd VH chain
CARDRTGRWDVW

SEQ ID NO: 1577 - protein, 12 aa, Artificial Sequence
  Made in Lab - CRDH3 from anti-Fzd VH chain
CASRGGDGMDVW

SEQ ID NO: 1578 - protein, 19 aa, Artificial Sequence
  Made in Lab - CRDH3 from anti-Fzd VH chain
CAREGYSSSWYSPEYFQHW

SEQ ID NO: 1579 - protein, 14 aa, Artificial Sequence
  Made in Lab - CRDH3 from anti-Fzd VH chain
CARAVRGVTPLGYW

SEQ ID NO: 1580 - protein, 13 aa, Artificial Sequence
  Made in Lab - CRDH3 from anti-Fzd VH chain
CARSTRGVGLDYW

SEQ ID NO: 1581 - protein, 8 aa, Artificial Sequence
  Made in Lab - CRDH3 from anti-Fzd VH chain
CARGSRHC

SEQ ID NO: 1582 - protein, 9 aa, Artificial Sequence
  Made in Lab - CRDH3 from anti-Fzd VH chain
CAHLKDDYW

SEQ ID NO: 1583 - protein, 11 aa, Artificial Sequence
  Made in Lab - CRDH3 from anti-Fzd VH chain
CARGGRYQGNW

SEQ ID NO: 1584 - protein, 12 aa, Artificial Sequence
  Made in Lab - CRDH3 from anti-Fzd VH chain
CARDGVDRFDYW

SEQ ID NO: 1585 - protein, 11 aa, Artificial Sequence
  Made in Lab - CRDH3 from anti-Fzd VH chain
CAREEYGMDVW

SEQ ID NO: 1586 - protein, 16 aa, Artificial Sequence
  Made in Lab - CRDH3 from anti-Fzd VH chain
CARALEWPNSGYFDYW

SEQ ID NO: 1587 - protein, 17 aa, Artificial Sequence
  Made in Lab - CRDH3 from anti-Fzd VH chain
CARDLIFRGSGYGMDVW

SEQ ID NO: 1588 - protein, 7 aa, Artificial Sequence
  Made in Lab - CRDH3 from anti-Fzd VH chain
CAIQDVW

SEQ ID NO: 1589 - protein, 19 aa, Artificial Sequence
  Made in Lab - CRDH3 from anti-Fzd VH chain
CARGPYSRTVPYYYGMDVW

SEQ ID NO: 1590 - protein, 8 aa, Artificial Sequence
  Made in Lab - CRDH3 from anti-Fzd VH chain
CARGKHYW

SEQ ID NO: 1591 - protein, 15 aa, Artificial Sequence
  Made in Lab - CRDH3 from anti-Fzd VH chain
CARSGSERLSGYSPR

SEQ ID NO: 1592 - protein, 19 aa, Artificial Sequence
  Made in Lab - CRDH3 from anti-Fzd VH chain
CARLTTSTVTTQYWYFDLW

SEQ ID NO: 1593 - protein, 16 aa, Artificial Sequence
  Made in Lab - CRDH3 from anti-Fzd VH chain
CARALEWPNSGYFDYW

SEQ ID NO: 1594 - protein, 12 aa, Artificial Sequence
  Made in Lab - CRDH3 from anti-Fzd VH chain
CARGLYGAFQYW

SEQ ID NO: 1595 - protein, 11 aa, Artificial Sequence
  Made in Lab - CRDH3 from anti-Fzd VH chain
CARGIGYMDVW

SEQ ID NO: 1596 - protein, 20 aa, Artificial Sequence
  Made in Lab - CRDH3 from anti-Fzd VH chain
CARINGTIVASYYYYGMDVW

SEQ ID NO: 1597 - protein, 7 aa, Artificial Sequence
  Made in Lab - CRDH3 from anti-Fzd VH chain
CASHRHW

SEQ ID NO: 1598 - protein, 16 aa, Artificial Sequence
  Made in Lab - CRDH3 from anti-Fzd VH chain
CAHVPPTGAAGAFDIW

SEQ ID NO: 1599 - protein, 17 aa, Artificial Sequence
  Made in Lab - CRDH3 from anti-Fzd VH chain
CARHNYDSYYYYGMDVW

SEQ ID NO: 1600 - protein, 13 aa, Artificial Sequence
  Made in Lab - CRDH3 from anti-Fzd VH chain
CARLGLEWEFDYW

SEQ ID NO: 1601 - protein, 9 aa, Artificial Sequence
  Made in Lab - CRDH3 from anti-Fzd VH chain
CARGSGGGW

SEQ ID NO: 1602 - protein, 11 aa, Artificial Sequence
  Made in Lab - CRDH3 from anti-Fzd VH chain
CARTGDGMDVW

SEQ ID NO: 1603 - protein, 14 aa, Artificial Sequence
  Made in Lab - CRDH3 from anti-Fzd VH chain
CATVPSGSYWVDYW

SEQ ID NO: 1604 - protein, 12 aa, Artificial Sequence
  Made in Lab - CRDH3 from anti-Fzd VH chain
CARDTGGTFNYW

SEQ ID NO: 1605 - protein, 12 aa, Artificial Sequence
  Made in Lab - CRDH3 from anti-Fzd VH chain
CARPRVEAFDIW

SEQ ID NO: 1606 - protein, 20 aa, Artificial Sequence
  Made in Lab - CRDH3 from anti-Fzd VH chain
CARDYSNYAFASYYYYMDVW

SEQ ID NO: 1607 - protein, 16 aa, Artificial Sequence
  Made in Lab - CRDH3 from anti-Fzd VH chain
CARMAYSYGYDWFDPW

SEQ ID NO: 1608 - protein, 13 aa, Artificial Sequence [sequence omitted]

SEQ ID NO: 1609 - protein, 7 aa, Artificial Sequence [sequence omitted]

SEQ ID NO: 1610 - protein, 19 aa, Artificial Sequence
  Made in Lab - CRDH3 from anti-Fzd VH chain
CARDRYCSGGSCTGLFDYW

SEQ ID NO: 1611 - protein, 11 aa, Artificial Sequence [sequence omitted]

SEQ ID NO: 1612 - protein, 16 aa, Artificial Sequence
  Made in Lab - CRDH3 from anti-Fzd VH chain
CARDPYGSGTGGMDVW

SEQ ID NO: 1613 - protein, 9 aa, Artificial Sequence [sequence omitted]

SEQ ID NO: 1614 - protein, 9 aa, Artificial Sequence
  Made in Lab - CRDH3 from anti-Fzd VH chain
CASRVSRSW

SEQ ID NO: 1615 - protein, 17 aa, Artificial Sequence
  Made in Lab - CRDH3 from anti-Fzd VH chain
CARDHPPRSSSRYFGLW

SEQ ID NO: 1616 - protein, 11 aa, Artificial Sequence
  Made in Lab - CRDH3 from anti-Fzd VH chain
CAREKQGMDVW

SEQ ID NO: 1617 - protein, 11 aa, Artificial Sequence
  Made in Lab - CRDH3 from anti-Fzd VH chain
CARGTGSGSSW

SEQ ID NO: 1618 - protein, 11 aa, Artificial Sequence
  Made in Lab - CRDH3 from anti-Fzd VH chain
CARALSRGNYW

SEQ ID NO: 1619 - protein, 21 aa, Artificial Sequence
  Made in Lab - CRDH3 from anti-Fzd VH chain
CARVGVGGYSYGLPYYYMDVW

SEQ ID NO: 1620 - protein, 8 aa, Artificial Sequence
  Made in Lab - CRDH3 from anti-Fzd VH chain
CARGKTNW

SEQ ID NO: 1621 - protein, 17 aa, Artificial Sequence
  Made in Lab - CRDH3 from anti-Fzd VH chain
CARGGRRSSGWYGVDYW

SEQ ID NO: 1622 - protein, 12 aa, Artificial Sequence
  Made in Lab - CRDH3 from anti-Fzd VH chain
CARVLIYGMDVW

SEQ ID NO: 1623 - protein, 12 aa, Artificial Sequence
  Made in Lab - CRDH3 from anti-Fzd VH chain
CARDTGGYMDVW

SEQ ID NO: 1624 - protein, 8 aa, Artificial Sequence
  Made in Lab - CRDH3 from anti-Fzd VH chain
CARKGDYW

SEQ ID NO: 1625 - protein, 12 aa, Artificial Sequence
  Made in Lab - CRDH3 from anti-Fzd VH chain
CARIGYYYMDVW

SEQ ID NO: 1626 - protein, 16 aa, Artificial Sequence
  Made in Lab - CRDH3 from anti-Fzd VH chain
CARGDLRWRGWYFDLW

SEQ ID NO: 1627 - protein, 13 aa, Artificial Sequence
  Made in Lab - CRDH3 from anti-Fzd VH chain
CARDYGDIGFDYW

SEQ ID NO: 1628 - protein, 12 aa, Artificial Sequence
  Made in Lab - CRDH3 from anti-Fzd VH chain
CARDHGDAFDIW

SEQ ID NO: 1629 - protein, 16 aa, Artificial Sequence
  Made in Lab - CRDH3 from anti-Fzd VH chain
CARDSGRYRGRYFDYW

SEQ ID NO: 1630 - protein, 11 aa, Artificial Sequence
  Made in Lab - CRDH3 from anti-Fzd VH chain
CASGAAAFDIW

SEQ ID NO: 1631 - protein, 7 aa, Artificial Sequence
  Made in Lab - CRDH3 from anti-Fzd VH chain
CAREEHW

SEQ ID NO: 1632 - protein, 18 aa, Artificial Sequence
  Made in Lab - CRDH3 from anti-Fzd VH chain
CARDRYSSSWAHLYFDLW

SEQ ID NO: 1633 - protein, 15 aa, Artificial Sequence
  Made in Lab - CRDH3 from anti-Fzd VH chain
CARVAARPQRALGYW

SEQ ID NO: 1634 - protein, 12 aa, Artificial Sequence
  Made in Lab - CRDH3 from anti-Fzd VH chain
CARVANWAVDYW

SEQ ID NO: 1635 - protein, 17 aa, Artificial Sequence
  Made in Lab - CRDH3 from anti-Fzd VH chain
CARHRYSSSWNYGMDVW

SEQ ID NO: 1636 - protein, 14 aa, Artificial Sequence
  Made in Lab - CRDH3 from anti-Fzd VH chain
CARTSKDVGLFDYW

SEQ ID NO: 1637 - protein, 10 aa, Artificial Sequence
  Made in Lab - CRDH3 from anti-Fzd VH chain
CARDGSLDLW

SEQ ID NO: 1638 - protein, 18 aa, Artificial Sequence
  Made in Lab - CRDH3 from anti-Fzd VH chain
CAKVYKYYDYVWGSLDYW

SEQ ID NO: 1639 - protein, 12 aa, Artificial Sequence
  Made in Lab - CRDH3 from anti-Fzd VH chain
CATLPRGRGNYW

SEQ ID NO: 1640 - protein, 22 aa, Artificial Sequence
  Made in Lab - CRDH3 from anti-Fzd VH chain
CAREGRYCSGGSCYSGWYFDLW

SEQ ID NO: 1641 - protein, 10 aa, Artificial Sequence
  Made in Lab - CRDH3 from anti-Fzd VH chain
CARDGSLDYW

SEQ ID NO: 1642 - protein, 10 aa, Artificial Sequence
  Made in Lab - CRDH3 from anti-Fzd VH chain
CARDASFDYW

SEQ ID NO: 1643 - protein, 10 aa, Artificial Sequence
  Made in Lab - CRDH3 from anti-Fzd VH chain
CARDGSMDVW

SEQ ID NO: 1644 - protein, 10 aa, Artificial Sequence
  Made in Lab - CRDH3 from anti-Fzd VH chain
CARDGSLDYW

SEQ ID NO: 1645 - protein, 10 aa, Artificial Sequence
  Made in Lab - CRDH3 from anti-Fzd VH chain
CARGGNRDYR

SEQ ID NO: 1646 - protein, 22 aa, Artificial Sequence
  Made in Lab - CRDH3 from anti-Fzd VH chain
CAREGRYCSGGSCYSGWYFDLW

SEQ ID NO: 1647 - protein, 18 aa, Artificial Sequence
  Made in Lab - CRDH3 from anti-Fzd VH chain
CAREARRGGWSTGYFDLW

SEQ ID NO: 1648 - protein, 18 aa, Artificial Sequence
  Made in Lab - CRDH3 from anti-Fzd VH chain
CAREARRGGWSTGYFDLW

SEQ ID NO: 1649 - protein, 16 aa, Artificial Sequence
  Made in Lab - CRDH3 from anti-Fzd VH chain
CARGPRTYSSSGFDYW

SEQ ID NO: 1650 - protein, 12 aa, Artificial Sequence
  Made in Lab - CRDH3 from anti-Fzd VH chain
CATLPRGKGNYW

SEQ ID NO: 1651 - protein, 15 aa, Artificial Sequence
  Made in Lab - CRDH3 from anti-Fzd VH chain
CAKGPSSGWYVFDYW

SEQ ID NO: 1652 - protein, 17 aa, Artificial Sequence
  Made in Lab - CRDH3 from anti-Fzd VH chain
CARDRGRWYGENWFDPW

SEQ ID NO: 1653 - protein, 11 aa, Artificial Sequence
  Made in Lab - CRDH3 from anti-Fzd VH chain
CARDYGGYDYW

SEQ ID NO: 1654 - protein, 14 aa, Artificial Sequence
  Made in Lab - CRDH3 from anti-Fzd VH chain
CARGRGGGYRGGYW

SEQ ID NO: 1655 - protein, 18 aa, Artificial Sequence
  Made in Lab - CRDH3 from anti-Fzd VH chain
CARDVMVRGVDYYGMDVW

SEQ ID NO: 1656 - protein, 10 aa, Artificial Sequence
  Made in Lab - CRDH3 from anti-Fzd VH chain
CARDGSMDVW

SEQ ID NO: 1657 - protein, 10 aa, Artificial Sequence
  Made in Lab - CRDH3 from anti-Fzd VH chain
CARDGSMDVW

SEQ ID NO: 1658 - protein, 15 aa, Artificial Sequence
  Made in Lab - CRDH3 from anti-Fzd VH chain
CARHDRHDYGDLDYW

SEQ ID NO: 1659 - protein, 16 aa, Artificial Sequence
  Made in Lab - CRDH3 from anti-Fzd VH chain
CARDGDYVSGYGMDVW

SEQ ID NO: 1660 - protein, 14 aa, Artificial Sequence
  Made in Lab - CRDH3 from anti-Fzd VH chain
CARRLQAVHWFDPW

SEQ ID NO: 1661 - protein, 10 aa, Artificial Sequence
  Made in Lab - CRDH3 from anti-Fzd VH chain
CARDGSMDVW

SEQ ID NO: 1662 - protein, 14 aa, Artificial Sequence
  Made in Lab - CRDH3 from anti-Fzd VH chain
CARRLQAVHWFDPW

SEQ ID NO: 1663 - protein, 10 aa, Artificial Sequence [sequence omitted]

SEQ ID NO: 1664 - protein, 14 aa, Artificial Sequence
  Made in Lab - CRDH3 from anti-Fzd VH chain
CATGVVTANTYDYW

SEQ ID NO: 1665 - protein, 16 aa, Artificial Sequence
  Made in Lab - CRDH3 from anti-Fzd VH chain
CARVHGGNSLFYFQHW

SEQ ID NO: 1666 - protein, 9 aa, Artificial Sequence [sequence omitted]

SEQ ID NO: 1667 - protein, 10 aa, Artificial Sequence
  Made in Lab - CRDH3 from anti-Fzd VH chain
CARDGSLDLW

SEQ ID NO: 1668 - protein, 16 aa, Artificial Sequence
  Made in Lab - CRDH3 from anti-Fzd VH chain
CARSSGGYSYGQIDYW

SEQ ID NO: 1669 - protein, 10 aa, Artificial Sequence
  Made in Lab - CRDH3 from anti-Fzd VH chain
CARDGSLDYW

SEQ ID NO: 1670 - protein, 10 aa, Artificial Sequence
  Made in Lab - CRDH3 from anti-Fzd VH chain
CARDGSGDYW

SEQ ID NO: 1671 - protein, 13 aa, Artificial Sequence
  Made in Lab - CRDH3 from anti-Fzd VH chain
CARGYWGGYFDLW

SEQ ID NO: 1672 - protein, 10 aa, Artificial Sequence
  Made in Lab - CRDH3 from anti-Fzd VH chain
CARDGSMDVW

SEQ ID NO: 1673 - protein, 15 aa, Artificial Sequence
  Made in Lab - CRDH3 from anti-Fzd VH chain
CARGPSQNYYGMDVW

SEQ ID NO: 1674 - protein, 21 aa, Artificial Sequence
  Made in Lab - CRDH3 from anti-Fzd VH chain
CARDRRYSSGQNYYYYYMDVW

SEQ ID NO: 1675 - protein, 11 aa, Artificial Sequence [sequence omitted]

SEQ ID NO: 1676 - protein, 10 aa, Artificial Sequence [sequence omitted]

SEQ ID NO: 1677 - protein, 13 aa, Artificial Sequence
  Made in Lab - CRDH3 from anti-Fzd VH chain
CARRHPIGAFDIW

SEQ ID NO: 1678 - protein, 10 aa, Artificial Sequence [sequence omitted]

SEQ ID NO: 1679 - protein, 10 aa, Artificial Sequence
  Made in Lab - CRDH3 from anti-Fzd VH chain
CARDGSLDYW

SEQ ID NO: 1680 - protein, 10 aa, Artificial Sequence [sequence omitted]

SEQ ID NO: 1681 - protein, 12 aa, Artificial Sequence
  Made in Lab - CRDH3 from anti-Fzd VH chain
CATLPRGRGNYW

SEQ ID NO: 1682 - protein, 10 aa, Artificial Sequence
  Made in Lab - CRDH3 from anti-Fzd VH chain
CARDGSLDLW

SEQ ID NO: 1683 - protein, 14 aa, Artificial Sequence
  Made in Lab - CRDH3 from anti-Fzd VH chain
CARGGYSNYGMDVW

SEQ ID NO: 1684 - protein, 10 aa, Artificial Sequence
  Made in Lab - CRDH3 from anti-Fzd VH chain
CARDGSMDVW

SEQ ID NO: 1685 - protein, 10 aa, Artificial Sequence [sequence omitted]

SEQ ID NO: 1686 - protein, 16 aa, Artificial Sequence
  Made in Lab - CRDH3 from anti-Fzd VH chain
CARDGDYVSGYGMDVW

SEQ ID NO: 1687 - protein, 7 aa, Artificial Sequence
  Made in Lab - CRDH3 from anti-Fzd VH chain
CAKIGTW

SEQ ID NO: 1688 - protein, 10 aa, Artificial Sequence
  Made in Lab - CRDH3 from anti-Fzd VH chain
CARDGSLDFW

SEQ ID NO: 1689 - protein, 10 aa, Artificial Sequence
  Made in Lab - CRDH3 from anti-Fzd VH chain
CARDGSLDYW

SEQ ID NO: 1690 - protein, 14 aa, Artificial Sequence
  Made in Lab - CRDH3 from anti-Fzd VH chain
CATGVVTANTYDYW

SEQ ID NO: 1691 - protein, 10 aa, Artificial Sequence [sequence omitted]

SEQ ID NO: 1692 - protein, 10 aa, Artificial Sequence
  Made in Lab - CRDH3 from anti-Fzd VH chain
CARDGSMDVW

SEQ ID NO: 1693 - protein, 10 aa, Artificial Sequence
  Made in Lab - CRDH3 from anti-Fzd VH chain
CARDGSMDVW

SEQ ID NO: 1694 - protein, 12 aa, Artificial Sequence
  Made in Lab - CRDH3 from anti-Fzd VH chain
CATLPRGRGNYW

SEQ ID NO: 1695 - protein, 10 aa, Artificial Sequence [sequence omitted]

SEQ ID NO: 1696 - protein, 10 aa, Artificial Sequence
  Made in Lab - CRDH3 from anti-Fzd VH chain
CARDGSLDLW

SEQ ID NO: 1697 - protein, 10 aa, Artificial Sequence
  Made in Lab - CRDH3 from anti-Fzd VH chain
CARDGSMDVW

SEQ ID NO: 1698 - protein, 10 aa, Artificial Sequence
  Made in Lab - CRDH3 from anti-Fzd VH chain
CARDGSMDVW

SEQ ID NO: 1699 - protein, 18 aa, Artificial Sequence
  Made in Lab - CRDH3 from anti-Fzd VH chain
CAREGRHDFWSGYFFDYW

SEQ ID NO: 1700 - protein, 10 aa, Artificial Sequence
  Made in Lab - CRDH3 from anti-Fzd VH chain
CARDGSMDVW

SEQ ID NO: 1701 - protein, 21 aa, Artificial Sequence
  Made in Lab - CRDH3 from anti-Fzd VH chain
CARAVGSSSSNYYYYYGMDVW

SEQ ID NO: 1702 - protein, 12 aa, Artificial Sequence
  Made in Lab - CRDH3 from anti-Fzd VH chain
CARVPRGGENYW

SEQ ID NO: 1703 - protein, 16 aa, Artificial Sequence
  Made in Lab - CRDH3 from anti-Fzd VH chain
CARGRKRSSGWHFDYW

SEQ ID NO: 1704 - protein, 14 aa, Artificial Sequence
  Made in Lab - CRDH3 from anti-Fzd VH chain
CAREGYSYYGMDVW

SEQ ID NO: 1705 - protein, 15 aa, Artificial Sequence
  Made in Lab - CRDH3 from anti-Fzd VH chain
CGKSYPYYYHCIDVW

SEQ ID NO: 1706 - protein, 12 aa, Artificial Sequence
  Made in Lab - CRDH3 from anti-Fzd VH chain
CARDLGYGFDYW

SEQ ID NO: 1707 - protein, 13 aa, Artificial Sequence
  Made in Lab - CRDH3 from anti-Fzd VH chain
CARHKDGGDMGYW

SEQ ID NO: 1708 - protein, 15 aa, Artificial Sequence
  Made in Lab - CRDH3 from anti-Fzd VH chain
CASYDYYYYYGMDVW

SEQ ID NO: 1709 - protein, 15 aa, Artificial Sequence
  Made in Lab - CRDH3 from anti-Fzd VH chain
CASYDYYYYYGMDVW

SEQ ID NO: 1710 - protein, 15 aa, Artificial Sequence
  Made in Lab - CRDH3 from anti-Fzd VH chain
CAKSDPYYYHGIDVW

SEQ ID NO: 1711 - protein, 13 aa, Artificial Sequence
  Made in Lab - CRDH3 from anti-Fzd VH chain
CARHKDGGDMGYW

SEQ ID NO: 1712 - protein, 15 aa, Artificial Sequence
  Made in Lab - CRDH3 from anti-Fzd VH chain
CARYSSSVYYGMDVW

SEQ ID NO: 1713 - protein, 17 aa, Artificial Sequence
  Made in Lab - CRDH3 from anti-Fzd VH chain
CARDGVAAAAAYYMDVW

SEQ ID NO: 1714 - protein, 14 aa, Artificial Sequence
  Made in Lab - CRDH3 from anti-Fzd VH chain
CAREGYSYYGMDVW

SEQ ID NO: 1715 - protein, 15 aa, Artificial Sequence
  Made in Lab - CRDH3 from anti-Fzd VH chain
CASYDYYYYYGMDVW

SEQ ID NO: 1716 - protein, 22 aa, Artificial Sequence
  Made in Lab - CRDH3 from anti-Fzd VH chain
CARDYGDYELGDNYYYYGMDVW

SEQ ID NO: 1717 - protein, 11 aa, Artificial Sequence
  Made in Lab - CRDH3 from anti-Fzd VH chain
CARSIAGMDVW

SEQ ID NO: 1718 - protein, 13 aa, Artificial Sequence
  Made in Lab - CRDH3 from anti-Fzd VH chain
CARHKDGGDMGYW

SEQ ID NO: 1719 - protein, 15 aa, Artificial Sequence
  Made in Lab - CRDH3 from anti-Fzd VH chain
CARFDGYYYYGMDVW

SEQ ID NO: 1720 - protein, 16 aa, Artificial Sequence
  Made in Lab - CRDH3 from anti-Fzd VH chain
CAKDRFAKDYGYFQHW

SEQ ID NO: 1721 - protein, 14 aa, Artificial Sequence
  Made in Lab - CRDH3 from anti-Fzd VH chain
CARDSRSGDYFDYW

SEQ ID NO: 1722 - protein, 19 aa, Artificial Sequence
  Made in Lab - CRDH3 from anti-Fzd VH chain
CARDIVWFGGYYYYGMDVW

SEQ ID NO: 1723 - protein, 8 aa, Artificial Sequence
  Made in Lab - CRDH3 from anti-Fzd VH chain
CARDSGHW

SEQ ID NO: 1724 - protein, 7 aa, Artificial Sequence [sequence omitted]

SEQ ID NO: 1725 - protein, 13 aa, Artificial Sequence
  Made in Lab - CRDH3 from anti-Fzd VH chain
CARGVSRRAFDIW

SEQ ID NO: 1726 - protein, 9 aa, Artificial Sequence [sequence omitted]

SEQ ID NO: 1727 - protein, 15 aa, Artificial Sequence
  Made in Lab - CRDH3 from anti-Fzd VH chain
CARQGVGAKYGMDVW

SEQ ID NO: 1728 - protein, 7 aa, Artificial Sequence
  Made in Lab - CRDH3 from anti-Fzd VH chain
CARSTNW

SEQ ID NO: 1729 - protein, 14 aa, Artificial Sequence
  Made in Lab - CRDH3 from anti-Fzd VH chain
CARTGTTYRSFDYW

SEQ ID NO: 1730 - protein, 14 aa, Artificial Sequence
  Made in Lab - CRDH3 from anti-Fzd VH chain
CASSSSSLRSHDYW

SEQ ID NO: 1731 - protein, 15 aa, Artificial Sequence
  Made in Lab - CRDH3 from anti-Fzd VH chain
CARLPGGAVAGFDYW

SEQ ID NO: 1732 - protein, 14 aa, Artificial Sequence
  Made in Lab - CRDH3 from anti-Fzd VH chain
CARDAVSRGRFDYW

SEQ ID NO: 1733 - protein, 8 aa, Artificial Sequence
  Made in Lab - CRDH3 from anti-Fzd VH chain
CATRMDVW

SEQ ID NO: 1734 - protein, 18 aa, Artificial Sequence
  Made in Lab - CRDH3 from anti-Fzd VH chain
CARTDALSVVRGVPFDYW

SEQ ID NO: 1735 - protein, 18 aa, Artificial Sequence
  Made in Lab - CRDH3 from anti-Fzd VH chain
CARVKVPAAGLNYWFDPW

SEQ ID NO: 1736 - protein, 14 aa, Artificial Sequence [sequence omitted]

SEQ ID NO: 1737 - protein, 15 aa, Artificial Sequence
  Made in Lab - CRDH3 from anti-Fzd VH chain
CARWTRDSSGYIDYW

SEQ ID NO: 1738 - protein, 7 aa, Artificial Sequence
  Made in Lab - CRDH3 from anti-Fzd VH chain
CASQDIW

SEQ ID NO: 1739 - protein, 8 aa, Artificial Sequence
  Made in Lab - CRDH3 from anti-Fzd VH chain
CARDKGNW

SEQ ID NO: 1740 - protein, 11 aa, Artificial Sequence
  Made in Lab - CRDH3 from anti-Fzd VH chain
CARGRKAFDIW

SEQ ID NO: 1741 - protein, 14 aa, Artificial Sequence
  Made in Lab - CRDH3 from anti-Fzd VH chain
CARSAAGTRAFDYW

SEQ ID NO: 1742 - protein, 13 aa, Artificial Sequence
  Made in Lab - CRDH3 from anti-Fzd VH chain
CARDSGDYYFDYW

SEQ ID NO: 1743 - protein, 12 aa, Artificial Sequence
  Made in Lab - CRDH3 from anti-Fzd VH chain
CARGGYGDEGPW

SEQ ID NO: 1744 - protein, 14 aa, Artificial Sequence
  Made in Lab - CRDH3 from anti-Fzd VH chain
CAKYSSSWYYFDYW

SEQ ID NO: 1745 - protein, 9 aa, Artificial Sequence [sequence omitted]

SEQ ID NO: 1746 - protein, 12 aa, Artificial Sequence
  Made in Lab - CRDH3 from anti-Fzd VH chain
CARGTRRMFDYW

SEQ ID NO: 1747 - protein, 18 aa, Artificial Sequence
  Made in Lab - CRDH3 from anti-Fzd VH chain
CARNNYYDSSGPKGIDYW

SEQ ID NO: 1748 - protein, 13 aa, Artificial Sequence
  Made in Lab - CRDH3 from anti-Fzd VH chain
CARSLIRRYFDLW

SEQ ID NO: 1749 - protein, 14 aa, Artificial Sequence
  Made in Lab - CRDH3 from anti-Fzd VH chain
CASSSSLVRAFDIW

SEQ ID NO: 1750 - protein, 15 aa, Artificial Sequence
  Made in Lab - CRDH3 from anti-Fzd VH chain
CARVGRDYYYGMDVW

SEQ ID NO: 1751 - protein, 15 aa, Artificial Sequence
  Made in Lab - CRDH3 from anti-Fzd VH chain
CARPGYSSGWAFDYW

SEQ ID NO: 1752 - protein, 20 aa, Artificial Sequence
  Made in Lab - CRDH3 from anti-Fzd VH chain
CAKGIAAAGTWSGYYGMDVW

SEQ ID NO: 1753 - protein, 17 aa, Artificial Sequence
  Made in Lab - CRDH3 from anti-Fzd VH chain
CARHQRAAAGRKGFDYW

SEQ ID NO: 1754 - protein, 15 aa, Artificial Sequence
  Made in Lab - CRDH3 from anti-Fzd VH chain
CARHALSSTGYMDVW

SEQ ID NO: 1755 - protein, 12 aa, Artificial Sequence
  Made in Lab - CRDH3 from anti-Fzd VH chain
CARGGRYAFDIW

SEQ ID NO: 1756 - protein, 17 aa, Artificial Sequence
  Made in Lab - CRDH3 from anti-Fzd VH chain
CARPRTVTRRGWYFDLW

SEQ ID NO: 1757 - protein, 8 aa, Artificial Sequence
  Made in Lab - CRDH3 from anti-Fzd VH chain
CARDRYYW

SEQ ID NO: 1758 - protein, 15 aa, Artificial Sequence
  Made in Lab - CRDH3 from anti-Fzd VH chain
CAREFRATGKSMDVW

SEQ ID NO: 1759 - protein, 8 aa, Artificial Sequence
  Made in Lab - CRDH3 from anti-Fzd VH chain
CARDKTAW

SEQ ID NO: 1760 - protein, 14 aa, Artificial Sequence
  Made in Lab - CRDH3 from anti-Fzd VH chain
CARGRNYGDYDDYW

SEQ ID NO: 1761 - protein, 11 aa, Artificial Sequence
  Made in Lab - CRDH3 from anti-Fzd VH chain
CTTRPWGSDYW

SEQ ID NO: 1762 - protein, 9 aa, Artificial Sequence
  Made in Lab - CRDH3 from anti-Fzd VH chain
CANDRLGYW

SEQ ID NO: 1763 - protein, 14 aa, Artificial Sequence
  Made in Lab - CRDH3 from anti-Fzd VH chain
CARGQWLAYGMDVW

SEQ ID NO: 1764 - protein, 16 aa, Artificial Sequence
  Made in Lab - CRDH3 from anti-Fzd VH chain
CARHYRYSGGGAFDIW

SEQ ID NO: 1765 - protein, 13 aa, Artificial Sequence
  Made in Lab - CRDH3 from anti-Fzd VH chain
CASSDKIRSLDVW

SEQ ID NO: 1766 - protein, 15 aa, Artificial Sequence
  Made in Lab - CRDH3 from anti-Fzd VH chain
CARVSPYSGWGFDYW

SEQ ID NO: 1767 - protein, 17 aa, Artificial Sequence
  Made in Lab - CRDH3 from anti-Fzd VH chain
CARYSGSYPQNWYFDLW

SEQ ID NO: 1768 - protein, 15 aa, Artificial Sequence
  Made in Lab - CRDH3 from anti-Fzd VH chain
CARAGRYYYYGMDVW

SEQ ID NO: 1769 - protein, 13 aa, Artificial Sequence
  Made in Lab - CRDH3 from anti-Fzd VH chain
CARTQFAGYFDLW

SEQ ID NO: 1770 - protein, 12 aa, Artificial Sequence
  Made in Lab - CRDH3 from anti-Fzd VH chain
CARGGYGDSGYW

SEQ ID NO: 1771 - protein, 14 aa, Artificial Sequence [sequence omitted]

SEQ ID NO: 1772 - protein, 14 aa, Artificial Sequence
  Made in Lab - CRDH3 from anti-Fzd VH chain
CAKSTDYSKAFDYW

SEQ ID NO: 1773 - protein, 11 aa, Artificial Sequence
  Made in Lab - CRDH3 from anti-Fzd VH chain
CARGRYAFDVW

SEQ ID NO: 1774 - protein, 14 aa, Artificial Sequence
  Made in Lab - CRDH3 from anti-Fzd VH chain
CARSGPGYRAFDIW

SEQ ID NO: 1775 - protein, 13 aa, Artificial Sequence [sequence omitted]

SEQ ID NO: 1776 - protein, 12 aa, Artificial Sequence
  Made in Lab - CRDH3 from anti-Fzd VH chain
CARSTPRVFDLW

SEQ ID NO: 1777 - protein, 18 aa, Artificial Sequence
  Made in Lab - CRDH3 from anti-Fzd VH chain
CARVTPYCGGDCYSDDYW

SEQ ID NO: 1778 - protein, 9 aa, Artificial Sequence [sequence omitted]

SEQ ID NO: 1779 - protein, 14 aa, Artificial Sequence
  Made in Lab - CRDH3 from anti-Fzd VH chain
CARAARSRYYMDVW

SEQ ID NO: 1780 - protein, 14 aa, Artificial Sequence
  Made in Lab - CRDH3 from anti-Fzd VH chain
CAKSSSSRRAFDYW

SEQ ID NO: 1781 - protein, 15 aa, Artificial Sequence
  Made in Lab - CRDH3 from anti-Fzd VH chain
CARVYRGSYYGMDVW

SEQ ID NO: 1782 - protein, 14 aa, Artificial Sequence
  Made in Lab - CRDH3 from anti-Fzd VH chain
CARTDYYYYYMDVW

SEQ ID NO: 1783 - protein, 14 aa, Artificial Sequence
  Made in Lab - CRDH3 from anti-Fzd VH chain
CARDSRLAREFDYW

SEQ ID NO: 1784 - protein, 8 aa, Artificial Sequence
  Made in Lab - CRDH3 from anti-Fzd VH chain
CASGGRHW

SEQ ID NO: 1785 - protein, 13 aa, Artificial Sequence
  Made in Lab - CRDH3 from anti-Fzd VH chain
CARDSGDYYFDYW

SEQ ID NO: 1786 - protein, 14 aa, Artificial Sequence
  Made in Lab - CRDH3 from anti-Fzd VH chain
CARTYPAIRAFDIW

SEQ ID NO: 1787 - protein, 11 aa, Artificial Sequence
  Made in Lab - CRDH3 from anti-Fzd VH chain
CARGGPSGDYW

SEQ ID NO: 1788 - protein, 11 aa, Artificial Sequence
  Made in Lab - CRDH3 from anti-Fzd VH chain
CARGGADFDYW

SEQ ID NO: 1789 - protein, 13 aa, Artificial Sequence
  Made in Lab - CRDH3 from anti-Fzd VH chain
CARGSYYGDYGPW

SEQ ID NO: 1790 - protein, 11 aa, Artificial Sequence
  Made in Lab - CRDH3 from anti-Fzd VH chain
CARFYDAFDIW

SEQ ID NO: 1791 - protein, 14 aa, Artificial Sequence
  Made in Lab - CRDH3 from anti-Fzd VH chain
CARSTIWGRAFDIW

SEQ ID NO: 1792 - protein, 19 aa, Artificial Sequence
  Made in Lab - CRDH3 from anti-Fzd VH chain
CARDGQGAGGYYYYGMDVW

SEQ ID NO: 1793 - protein, 8 aa, Artificial Sequence
  Made in Lab - CRDH3 from anti-Fzd VH chain
CARGGRIW

SEQ ID NO: 1794 - protein, 14 aa, Artificial Sequence
  Made in Lab - CRDH3 from anti-Fzd VH chain
CARGRRAARTFDYW

SEQ ID NO: 1795 - protein, 14 aa, Artificial Sequence
  Made in Lab - CRDH3 from anti-Fzd VH chain
CAKVLRSGRNFDYW

SEQ ID NO: 1796 - protein, 11 aa, Artificial Sequence [sequence omitted]

SEQ ID NO: 1797 - protein, 15 aa, Artificial Sequence
  Made in Lab - CRDH3 from anti-Fzd VH chain
CARVGSGWSRAFDYW

SEQ ID NO: 1798 - protein, 13 aa, Artificial Sequence
  Made in Lab - CRDH3 from anti-Fzd VH chain
CARDNQDYYFDYW

SEQ ID NO: 1799 - protein, 23 aa, Artificial Sequence
  Made in Lab - CRDH3 from anti-Fzd VH chain
CARDRVEQLDGAKRYYYYGMDVW

SEQ ID NO: 1800 - protein, 12 aa, Artificial Sequence
  Made in Lab - CRDH3 from anti-Fzd VH chain
CAKALRGGLDYW

SEQ ID NO: 1801 - protein, 12 aa, Artificial Sequence
  Made in Lab - CRDH3 from anti-Fzd VH chain
CARTRVAYFDYW

SEQ ID NO: 1802 - protein, 16 aa, Artificial Sequence
  Made in Lab - CRDH3 from anti-Fzd VH chain
CARDLRKAGTRWFDPW

SEQ ID NO: 1803 - protein, 7 aa, Artificial Sequence
  Made in Lab - CRDH3 from anti-Fzd VH chain
CALRGVW

SEQ ID NO: 1804 - protein, 14 aa, Artificial Sequence
  Made in Lab - CRDH3 from anti-Fzd VH chain
CAKEATGTGAFQHW

SEQ ID NO: 1805 - protein, 16 aa, Artificial Sequence
  Made in Lab - CRDH3 from anti-Fzd VH chain
CARSGSSRYYYGMDVW

SEQ ID NO: 1806 - protein, 14 aa, Artificial Sequence
  Made in Lab - CRDH3 from anti-Fzd VH chain
CANSLPAPHAFDIW

SEQ ID NO: 1807 - protein, 16 aa, Artificial Sequence
  Made in Lab - CRDH3 from anti-Fzd VH chain
CARDSGTRRWHGMDVW

SEQ ID NO: 1808 - protein, 10 aa, Artificial Sequence
  Made in Lab - CRDH3 from anti-Fzd VH chain
CARGLGGETW

SEQ ID NO: 1809 - protein, 8 aa, Artificial Sequence
  Made in Lab - CRDH3 from anti-Fzd VH chain
CARDRNYW

SEQ ID NO: 1810 - protein, 19 aa, Artificial Sequence
  Made in Lab - CRDH3 from anti-Fzd VH chain
CARESIAAPVRSYNWFDPW

SEQ ID NO: 1811 - protein, 14 aa, Artificial Sequence
  Made in Lab - CRDH3 from anti-Fzd VH chain
CARDRKARGALWYW

SEQ ID NO: 1812 - protein, 14 aa, Artificial Sequence
  Made in Lab - CRDH3 from anti-Fzd VH chain
CARDRRAIYGMDVW

SEQ ID NO: 1813 - protein, 14 aa, Artificial Sequence
  Made in Lab - CRDH3 from anti-Fzd VH chain
CARSYSSGRAFDYW

SEQ ID NO: 1814 - protein, 17 aa, Artificial Sequence
  Made in Lab - CRDH3 from anti-Fzd VH chain
CATAKVKHPRDDAFDIW

SEQ ID NO: 1815 - protein, 16 aa, Artificial Sequence
  Made in Lab - CRDH3 from anti-Fzd VH chain
CARVLAVAGQYYFDYW

SEQ ID NO: 1816 - protein, 15 aa, Artificial Sequence
  Made in Lab - CRDH3 from anti-Fzd VH chain
CARHKRTVTAFMDVW

SEQ ID NO: 1817 - protein, 22 aa, Artificial Sequence
  Made in Lab - CRDH3 from anti-Fzd VH chain
CARDDIYSSSSVDYYYYGMDVW

SEQ ID NO: 1818 - protein, 22 aa, Artificial Sequence
  Made in Lab - CRDH3 from anti-Fzd VH chain
CARDDIYSSSSVDYYYYGMDVW

SEQ ID NO: 1819 - protein, 19 aa, Artificial Sequence
  Made in Lab - CRDH3 from anti-Fzd VH chain
CARHVGSVAHTYQNWFDPW

SEQ ID NO: 1820 - protein, 22 aa, Artificial Sequence
  Made in Lab - CRDH3 from anti-Fzd VH chain
CARDDIYSSSSVDYYYYGMDVW

SEQ ID NO: 1821 - protein, 14 aa, Artificial Sequence
  Made in Lab - CRDH3 from anti-Fzd VH chain
CARGFGYGDYSTYW

SEQ ID NO: 1822 - protein, 17 aa, Artificial Sequence
  Made in Lab - CRDH3 from anti-Fzd VH chain
CARVGYSSGWKDAFDIW

SEQ ID NO: 1823 - protein, 15 aa, Artificial Sequence
  Made in Lab - CRDH3 from anti-Fzd VH chain
CARGGDSYYYYMDVW

SEQ ID NO: 1824 - protein, 14 aa, Artificial Sequence
  Made in Lab - CRDH3 from anti-Fzd VH chain
CARGDYYGSGAGYW

SEQ ID NO: 1825 - protein, 17 aa, Artificial Sequence
  Made in Lab - CRDH3 from anti-Fzd VH chain
CARVFYDSSGYYYFDYW

SEQ ID NO: 1826 - protein, 14 aa, Artificial Sequence
  Made in Lab - CRDH3 from anti-Fzd VH chain
CARDQWKPYYFDFW

SEQ ID NO: 1827 - protein, 15 aa, Artificial Sequence
  Made in Lab - CRDH3 from anti-Fzd VH chain
CARAVGRVGATLDYW

SEQ ID NO: 1828 - protein, 13 aa, Artificial Sequence
  Made in Lab - CRDH3 from anti-Fzd VH chain
CARGNIVGAIDYW

SEQ ID NO: 1829 - protein, 14 aa, Artificial Sequence
  Made in Lab - CRDH3 from anti-Fzd VH chain
CARDQWKPYYFDSW

SEQ ID NO: 1830 - protein, 14 aa, Artificial Sequence
  Made in Lab - CRDH3 from anti-Fzd VH chain
CARTATCGYYFDYW

SEQ ID NO: 1831 - protein, 15 aa, Artificial Sequence
  Made in Lab - CRDH3 from anti-Fzd VH chain
CAKEGWLLSYAFDIW

SEQ ID NO: 1832 - protein, 8 aa, Artificial Sequence
  Made in Lab - CRDH3 from anti-Fzd VH chain
CVVRGDYW

SEQ ID NO: 1833 - protein, 15 aa, Artificial Sequence
  Made in Lab - CRDH3 from anti-Fzd VH chain
CAKEGWLLSYAFDIW

SEQ ID NO: 1834 - protein, 15 aa, Artificial Sequence
  Made in Lab - CRDH3 from anti-Fzd VH chain
CASLIITENQAFDFW

SEQ ID NO: 1835 - protein, 14 aa, Artificial Sequence
  Made in Lab - CRDH3 from anti-Fzd VH chain
CARTYRCGYSLDYW

SEQ ID NO: 1836 - protein, 11 aa, Artificial Sequence
  Made in Lab - CRDH3 from anti-Fzd VH chain
CTTDSRWFDIW

SEQ ID NO: 1837 - protein, 8 aa, Artificial Sequence
  Made in Lab - CRDH3 from anti-Fzd VH chain
CVVRGDYW

SEQ ID NO: 1838 - protein, 15 aa, Artificial Sequence
  Made in Lab - CRDH3 from anti-Fzd VH chain
CAKEGWLLSYAFDIW

SEQ ID NO: 1839 - protein, 11 aa, Artificial Sequence
  Made in Lab - CRDH3 from anti-Fzd VH chain
CVRGGYDFDSW

SEQ ID NO: 1840 - protein, 11 aa, Artificial Sequence
  Made in Lab - CRDH3 from anti-Fzd VH chain
CARGGPFGSNW

SEQ ID NO: 1841 - protein, 15 aa, Artificial Sequence
  Made in Lab - CRDH3 from anti-Fzd VH chain
CAKEGWLLSYAFDIW

SEQ ID NO: 1842 - protein, 15 aa, Artificial Sequence
  Made in Lab - CRDH3 from anti-Fzd VH chain
CAKEGWLLSYAFDIW

SEQ ID NO: 1843 - protein, 8 aa, Artificial Sequence
  Made in Lab - CRDH3 from anti-Fzd VH chain
CVVRGDYW

SEQ ID NO: 1844 - protein, 15 aa, Artificial Sequence
  Made in Lab - CRDH3 from anti-Fzd VH chain
CAKEGWLLSYAFDIW

SEQ ID NO: 1845 - protein, 8 aa, Artificial Sequence
  Made in Lab - CRDH3 from anti-Fzd VH chain
CASTPGFW

SEQ ID NO: 1846 - protein, 11 aa, Artificial Sequence
  Made in Lab - CRDH3 from anti-Fzd VH chain
CVRGGYDFDSW

SEQ ID NO: 1847 - protein, 11 aa, Artificial Sequence
  Made in Lab - CRDH3 from anti-Fzd VH chain
CATRGRYFDYW

SEQ ID NO: 1848 - protein, 8 aa, Artificial Sequence
  Made in Lab - CRDH3 from anti-Fzd VH chain
CASSPGYW

SEQ ID NO: 1849 - protein, 15 aa, Artificial Sequence
  Made in Lab - CRDH3 from anti-Fzd VH chain
CAKEGWLLSYAFDIW

SEQ ID NO: 1850 - protein, 8 aa, Artificial Sequence
  Made in Lab - CRDH3 from anti-Fzd VH chain
CVVRGDYW

SEQ ID NO: 1851 - protein, 14 aa, Artificial Sequence
  Made in Lab - CRDH3 from anti-Fzd VH chain
CARTDTSGYYFDYW

SEQ ID NO: 1852 - protein, 12 aa, Artificial Sequence
  Made in Lab - CRDH3 from anti-Fzd VH chain
CARGSTYYFDYW

SEQ ID NO: 1853 - protein, 13 aa, Artificial Sequence
  Made in Lab - CRDH3 from anti-Fzd VH chain
CARAWRADAFDIW

SEQ ID NO: 1854 - protein, 8 aa, Artificial Sequence
  Made in Lab - CRDH3 from anti-Fzd VH chain
CARGGKDW

SEQ ID NO: 1855 - protein, 22 aa, Artificial Sequence
  Made in Lab - CRDH3 from anti-Fzd VH chain
CALRVPVITFGGVIGDDAFDIW

SEQ ID NO: 1856 - protein, 8 aa, Artificial Sequence
  Made in Lab - CRDH3 from anti-Fzd VH chain
CARGGKDW

SEQ ID NO: 1857 - protein, 15 aa, Artificial Sequence
  Made in Lab - CRDH3 from anti-Fzd VH chain
CARYGHSSGWSFDYW

SEQ ID NO: 1858 - protein, 10 aa, Artificial Sequence
  Made in Lab - CRDH3 from anti-Fzd VH chain
CATGGPIDYW

SEQ ID NO: 1859 - protein, 8 aa, Artificial Sequence
  Made in Lab - CRDH3 from anti-Fzd VH chain
CASQSRGW

SEQ ID NO: 1860 - protein, 8 aa, Artificial Sequence
  Made in Lab - CRDH3 from anti-Fzd VH chain
CVVRGDYW

SEQ ID NO: 1861 - protein, 9 aa, Artificial Sequence
  Made in Lab - CRDH3 from anti-Fzd VH chain
CARGGAGEW

SEQ ID NO: 1862 - protein, 14 aa, Artificial Sequence
  Made in Lab - CRDH3 from anti-Fzd VH chain
CARTATSGYYFDYW

SEQ ID NO: 1863 - protein, 10 aa, Artificial Sequence
  Made in Lab - CRDH3 from anti-Fzd VH chain
CATGGPIDYW

SEQ ID NO: 1864 - protein, 21 aa, Artificial Sequence
  Made in Lab - CRDH3 from anti-Fzd VH chain
CATAGVGAVAGTIHLDAFDIW

SEQ ID NO: 1865 - protein, 14 aa, Artificial Sequence
  Made in Lab - CRDH3 from anti-Fzd VH chain
CARTDTCGYYFDYW

SEQ ID NO: 1866 - protein, 8 aa, Artificial Sequence
  Made in Lab - CRDH3 from anti-Fzd VH chain
CARGGKDW

SEQ ID NO: 1867 - protein, 10 aa, Artificial Sequence
  Made in Lab - CRDH3 from anti-Fzd VH chain
CAGGGALDYW

SEQ ID NO: 1868 - protein, 8 aa, Artificial Sequence
  Made in Lab - CRDH3 from anti-Fzd VH chain
CVVRGDYW

SEQ ID NO: 1869 - protein, 8 aa, Artificial Sequence
  Made in Lab - CRDH3 from anti-Fzd VH chain
CVVRGDYW

SEQ ID NO: 1870 - protein, 11 aa, Artificial Sequence
  Made in Lab - CRDH3 from anti-Fzd VH chain
CANPTYGMDVW

SEQ ID NO: 1871 - protein, 12 aa, Artificial Sequence
  Made in Lab - CRDH3 from anti-Fzd VH chain
CARDQGGATDYW

SEQ ID NO: 1872 - protein, 16 aa, Artificial Sequence
  Made in Lab - CRDH3 from anti-Fzd VH chain
CAKGYSGSYSLYFDYW

SEQ ID NO: 1873 - protein, 13 aa, Artificial Sequence
  Made in Lab - CRDH3 from anti-Fzd VH chain
CAKATANDAFDIW

SEQ ID NO: 1874 - protein, 12 aa, Artificial Sequence
  Made in Lab - CRDH3 from anti-Fzd VH chain
CSRGGSYAFDYW

SEQ ID NO: 1875 - protein, 12 aa, Artificial Sequence
  Made in Lab - CRDH3 from anti-Fzd VH chain
CAKSSGGGFDLW

SEQ ID NO: 1876 - protein, 15 aa, Artificial Sequence
  Made in Lab - CRDH3 from anti-Fzd VH chain
CAKVTVGASRSFDYW

SEQ ID NO: 1877 - protein, 15 aa, Artificial Sequence
  Made in Lab - CRDH3 from anti-Fzd VH chain
CAKSTGSLYRAFDYW

SEQ ID NO: 1878 - protein, 18 aa, Artificial Sequence
  Made in Lab - CRDH3 from anti-Fzd VH chain
CAKDSYYGSGSDDAFDIW

SEQ ID NO: 1879 - protein, 10 aa, Artificial Sequence
  Made in Lab - CRDH3 from anti-Fzd VH chain
CATGGPIDYW

SEQ ID NO: 1880 - protein, 20 aa, Artificial Sequence
  Made in Lab - CRDH3 from anti-Fzd VH chain
CAKVAPGLGSGARGYGMDVW

SEQ ID NO: 1881 - protein, 8 aa, Artificial Sequence
  Made in Lab - CRDH3 from anti-Fzd VH chain
CVVRGDYW

SEQ ID NO: 1882 - protein, 14 aa, Artificial Sequence
  Made in Lab - CRDH3 from anti-Fzd VH chain
CARGLFGVVIDPAW

SEQ ID NO: 1883 - protein, 17 aa, Artificial Sequence
  Made in Lab - CRDH3 from anti-Fzd VH chain
CLRRAYSDYEVRGEEPW

SEQ ID NO: 1884 - protein, 10 aa, Artificial Sequence
  Made in Lab - CRDH3 from anti-Fzd VH chain
CATGGPIDYW

SEQ ID NO: 1885 - protein, 15 aa, Artificial Sequence
  Made in Lab - CRDH3 from anti-Fzd VH chain
CARGGPYSSGWIDYW

SEQ ID NO: 1886 - protein, 15 aa, Artificial Sequence
  Made in Lab - CRDH3 from anti-Fzd VH chain
CARGPNYYDSSADYW

SEQ ID NO: 1887 - protein, 15 aa, Artificial Sequence
  Made in Lab - CRDH3 from anti-Fzd VH chain
CARGPNYYDSSADYW

SEQ ID NO: 1888 - protein, 13 aa, Artificial Sequence
  Made in Lab - CRDH3 from anti-Fzd VH chain
CARVSRGGDFDYW

SEQ ID NO: 1889 - protein, 15 aa, Artificial Sequence
  Made in Lab - CRDH3 from anti-Fzd VH chain
CAKEGWLLSYAFDIW

SEQ ID NO: 1890 - protein, 8 aa, Artificial Sequence
  Made in Lab - CRDH3 from anti-Fzd VH chain
CVVRGDYW

SEQ ID NO: 1891 - protein, 8 aa, Artificial Sequence
  Made in Lab - CRDH3 from anti-Fzd VH chain
CVVRGDYW

SEQ ID NO: 1892 - protein, 13 aa, Artificial Sequence
  Made in Lab - CRDH3 from anti-Fzd VH chain
CAKATANDAFDIW

SEQ ID NO: 1893 - protein, 18 aa, Artificial Sequence
  Made in Lab - CRDH3 from anti-Fzd VH chain
CAKDSYYGSGSDDAFDIW

SEQ ID NO: 1894 - protein, 9 aa, Artificial Sequence
  Made in Lab - CRDH3 from anti-Fzd VH chain
CAKGTTAGW

SEQ ID NO: 1895 - protein, 15 aa, Artificial Sequence
  Made in Lab - CRDH3 from anti-Fzd VH chain
CARERSSGSYGMDVW

SEQ ID NO: 1896 - protein, 12 aa, Artificial Sequence
  Made in Lab - CRDH3 from anti-Fzd VH chain
CARDKGGYSLYW

SEQ ID NO: 1897 - protein, 15 aa, Artificial Sequence
  Made in Lab - CRDH3 from anti-Fzd VH chain
CARGSSSGWYYFDYW

SEQ ID NO: 1898 - protein, 14 aa, Artificial Sequence
  Made in Lab - CRDH3 from anti-Fzd VH chain
CAREGRLSYGMDAW

SEQ ID NO: 1899 - protein, 14 aa, Artificial Sequence
  Made in Lab - CRDH3 from anti-Fzd VH chain
CAATPRWTTWFQHW

SEQ ID NO: 1900 - protein, 15 aa, Artificial Sequence
  Made in Lab - CRDH3 from anti-Fzd VH chain
CARDLENGAIYFQHW

SEQ ID NO: 1901 - protein, 15 aa, Artificial Sequence
  Made in Lab - CRDH3 from anti-Fzd VH chain
CARHGKWEPSLVDPW

SEQ ID NO: 1902 - protein, 15 aa, Artificial Sequence
  Made in Lab - CRDH3 from anti-Fzd VH chain
CAQQYYVLGEYFDYW

SEQ ID NO: 1903 - protein, 11 aa, Artificial Sequence
  Made in Lab - CRDH3 from anti-Fzd VH chain
CARGVDYMDVW

SEQ ID NO: 1904 - protein, 13 aa, Artificial Sequence
  Made in Lab - CRDH3 from anti-Fzd VH chain
CARRIVGAAFDYW

SEQ ID NO: 1905 - protein, 14 aa, Artificial Sequence
  Made in Lab - CRDH3 from anti-Fzd VH chain
CARDDKRTGTLDYW

SEQ ID NO: 1906 - protein, 13 aa, Artificial Sequence
  Made in Lab - CRDH3 from anti-Fzd VH chain
CARVGNHDAFDIW

SEQ ID NO: 1907 - protein, 18 aa, Artificial Sequence
  Made in Lab - CRDH3 from anti-Fzd VH chain
CAIRVRASGLFPNGMDVW

SEQ ID NO: 1908 - protein, 15 aa, Artificial Sequence
  Made in Lab - CRDH3 from anti-Fzd VH chain
CATGIAVAGIPYDYW

SEQ ID NO: 1909 - protein, 19 aa, Artificial Sequence
  Made in Lab - CRDH3 from anti-Fzd VH chain
CARDQYYYGSGSQPGMDVW

SEQ ID NO: 1910 - protein, 13 aa, Artificial Sequence
  Made in Lab - CRDH3 from anti-Fzd VH chain
CASQDVEGALDYW

SEQ ID NO: 1911 - protein, 9 aa, Artificial Sequence
  Made in Lab - CRDH3 from anti-Fzd VH chain
CARDMGDIW

SEQ ID NO: 1912 - protein, 12 aa, Artificial Sequence
  Made in Lab - CRDH3 from anti-Fzd VH chain
CAAGQGGYFDYW

SEQ ID NO: 1913 - protein, 11 aa, Artificial Sequence [sequence omitted]

SEQ ID NO: 1914 - protein, 19 aa, Artificial Sequence
  Made in Lab - CRDH3 from anti-Fzd VH chain
CARGGQQLDYYYYYGMDVW

SEQ ID NO: 1915 - protein, 14 aa, Artificial Sequence
  Made in Lab - CRDH3 from anti-Fzd VH chain
CTRLRRSEYYFDYW

SEQ ID NO: 1916 - protein, 20 aa, Artificial Sequence
  Made in Lab - CRDH3 from anti-Fzd VH chain
CARDQWNIVGATYYYGMDVW

SEQ ID NO: 1917 - protein, 15 aa, Artificial Sequence
  Made in Lab - CRDH3 from anti-Fzd VH chain
CARHGRGRDFGMDVW

SEQ ID NO: 1918 - protein, 13 aa, Artificial Sequence
  Made in Lab - CRDH3 from anti-Fzd VH chain
CARDGSGYELDYW

SEQ ID NO: 1919 - protein, 20 aa, Artificial Sequence
  Made in Lab - CRDH3 from anti-Fzd VH chain
CARDPTTVTPLGYYYGMDVW

SEQ ID NO: 1920 - protein, 14 aa, Artificial Sequence
  Made in Lab - CRDH3 from anti-Fzd VH chain
CARDLVAGYYFDYW

SEQ ID NO: 1921 - protein, 18 aa, Artificial Sequence
  Made in Lab - CRDH3 from anti-Fzd VH chain
CTTRVGRYPTYYYGMDVW

SEQ ID NO: 1922 - protein, 13 aa, Artificial Sequence
  Made in Lab - CRDH3 from anti-Fzd VH chain
CARGQVLRFFDVW

SEQ ID NO: 1923 - protein, 12 aa, Artificial Sequence
  Made in Lab - CRDH3 from anti-Fzd VH chain
CARTYGDYFDYW

SEQ ID NO: 1924 - protein, 16 aa, Artificial Sequence
  Made in Lab - CRDH3 from anti-Fzd VH chain
CARLTRKGADYYFDYW

SEQ ID NO: 1925 - protein, 16 aa, Artificial Sequence
  Made in Lab - CRDH3 from anti-Fzd VH chain
CARGGSNYYYYGMDVW

SEQ ID NO: 1926 - protein, 11 aa, Artificial Sequence
  Made in Lab - CRDH3 from anti-Fzd VH chain
CARGQGYMDVW

SEQ ID NO: 1927 - protein, 16 aa, Artificial Sequence
  Made in Lab - CRDH3 from anti-Fzd VH chain
CARDRPYYDGYGMDVW

SEQ ID NO: 1928 - protein, 14 aa, Artificial Sequence
  Made in Lab - CRDH3 from anti-Fzd VH chain
CARVRRHGGHSDYW

SEQ ID NO: 1929 - protein, 14 aa, Artificial Sequence
  Made in Lab - CRDH3 from anti-Fzd VH chain
CAHIARKQYYFDYW

SEQ ID NO: 1930 - protein, 24 aa, Artificial Sequence
  Made in Lab - CRDH3 from anti-Fzd VH chain
CARGSYPLAVGATLYYYYYGMDVW

SEQ ID NO: 1931 - protein, 14 aa, Artificial Sequence
  Made in Lab - CRDH3 from anti-Fzd VH chain
CTTDGGLGYAFDIW

SEQ ID NO: 1932 - protein, 13 aa, Artificial Sequence
  Made in Lab - CRDH3 from anti-Fzd VH chain
CTRPAKYGDLDYW

SEQ ID NO: 1933 - protein, 11 aa, Artificial Sequence
  Made in Lab - CRDH3 from anti-Fzd VH chain
CAKGVDTFDYW

SEQ ID NO: 1934 - protein, 13 aa, Artificial Sequence [sequence omitted]

SEQ ID NO: 1935 - protein, 15 aa, Artificial Sequence
  Made in Lab - CRDH3 from anti-Fzd VH chain
CARDSGSNGYAFDIW

SEQ ID NO: 1936 - protein, 17 aa, Artificial Sequence
  Made in Lab - CRDH3 from anti-Fzd VH chain
CAKDRRQLVRSAWFDPW

SEQ ID NO: 1937 - protein, 17 aa, Artificial Sequence
  Made in Lab - CRDH3 from anti-Fzd VH chain
CARGPARRHYYYGMDVW

SEQ ID NO: 1938 - protein, 18 aa, Artificial Sequence
  Made in Lab - CRDH3 from anti-Fzd VH chain
CAKDLIAAAGTGYGMDVW

SEQ ID NO: 1939 - protein, 11 aa, Artificial Sequence
  Made in Lab - CRDH3 from anti-Fzd VH chain
CASGVYGMDVW

SEQ ID NO: 1940 - protein, 16 aa, Artificial Sequence
  Made in Lab - CRDH3 from anti-Fzd VH chain
CARDLLGAVGYGMDVW

SEQ ID NO: 1941 - protein, 24 aa, Artificial Sequence
  Made in Lab - CRDH3 from anti-Fzd VH chain
CARDLTEAPTGTTRYYYYYGMDVW

SEQ ID NO: 1942 - protein, 20 aa, Artificial Sequence
  Made in Lab - CRDH3 from anti-Fzd VH chain
CARQYYDFWSGYPLSGMDVW

SEQ ID NO: 1943 - protein, 16 aa, Artificial Sequence
  Made in Lab - CRDH3 from anti-Fzd VH chain
CTTELDILTGYGFDYW

SEQ ID NO: 1944 - protein, 23 aa, Artificial Sequence
  Made in Lab - CRDH3 from anti-Fzd VH chain
CARDLRDIVGATRHYYYYGMDVW

SEQ ID NO: 1945 - protein, 18 aa, Artificial Sequence
  Made in Lab - CRDH3 from anti-Fzd VH chain
CASQYNWNDGYYYGMDVW

SEQ ID NO: 1946 - protein, 15 aa, Artificial Sequence
  Made in Lab - CRDH3 from anti-Fzd VH chain
CARDRGSSGYYLGYW

SEQ ID NO: 1947 - protein, 13 aa, Artificial Sequence [sequence omitted]

SEQ ID NO: 1948 - protein, 14 aa, Artificial Sequence
  Made in Lab - CRDH3 from anti-Fzd VH chain
CARGRDIGGIFDYW

SEQ ID NO: 1949 - protein, 14 aa, Artificial Sequence
  Made in Lab - CRDH3 from anti-Fzd VH chain
CASGIGYYYGMDVW

SEQ ID NO: 1950 - protein, 12 aa, Artificial Sequence [sequence omitted]

SEQ ID NO: 1951 - protein, 22 aa, Artificial Sequence
  Made in Lab - CRDH3 from anti-Fzd VH chain
CAKVGGYSSSWYPSYYYGMDVW

SEQ ID NO: 1952 - protein, 13 aa, Artificial Sequence [sequence omitted]

SEQ ID NO: 1953 - protein, 14 aa, Artificial Sequence
  Made in Lab - CRDH3 from anti-Fzd VH chain
CARDQYGGYAFDYW

SEQ ID NO: 1954 - protein, 12 aa, Artificial Sequence
  Made in Lab - CRDH3 from anti-Fzd VH chain
CVRSSGGYLDLW

SEQ ID NO: 1955 - protein, 15 aa, Artificial Sequence
  Made in Lab - CRDH3 from anti-Fzd VH chain
CARDSGSNGYAFDIW

SEQ ID NO: 1956 - protein, 17 aa, Artificial Sequence
  Made in Lab - CRDH3 from anti-Fzd VH chain
CAREGRYGYDGAWFAYW

SEQ ID NO: 1957 - protein, 23 aa, Artificial Sequence
  Made in Lab - CRDH3 from anti-Fzd VH chain
CARQAGLHCSSTSCYLGNWFDPW

SEQ ID NO: 1958 - protein, 14 aa, Artificial Sequence
  Made in Lab - CRDH3 from anti-Fzd VH chain
CARFGWYYYGMDVW

SEQ ID NO: 1959 - protein, 20 aa, Artificial Sequence
  Made in Lab - CRDH3 from anti-Fzd VH chain
CAKYSSSWYGQDQHDAFDIW

SEQ ID NO: 1960 - protein, 15 aa, Artificial Sequence
  Made in Lab - CRDH3 from anti-Fzd VH chain
CARDDPYGYFLMDFW

SEQ ID NO: 1961 - protein, 15 aa, Artificial Sequence
  Made in Lab - CRDH3 from anti-Fzd VH chain
CARDSDYDWSWFYPW

SEQ ID NO: 1962 - protein, 16 aa, Artificial Sequence
  Made in Lab - CRDH3 from anti-Fzd VH chain
CAKEADGNYFYGLDVW

SEQ ID NO: 1963 - protein, 26 aa, Artificial Sequence
  Made in Lab - CRDH3 from anti-Fzd VH chain
CTTSLYYDSSGYYSSPYYYYYGMDVW

SEQ ID NO: 1964 - protein, 14 aa, Artificial Sequence
  Made in Lab - CRDH3 from anti-Fzd VH chain
CAREYSSSLVFDLW

SEQ ID NO: 1965 - protein, 10 aa, Artificial Sequence
  Made in Lab - CRDH3 from anti-Fzd VH chain
CARDRCYDFW

SEQ ID NO: 1966 - protein, 15 aa, Artificial Sequence
  Made in Lab - CRDH3 from anti-Fzd VH chain
CATSSSGEHYYMDVW

SEQ ID NO: 1967 - protein, 15 aa, Artificial Sequence
  Made in Lab - CRDH3 from anti-Fzd VH chain
CARDSDYDWSWFYPW

SEQ ID NO: 1968 - protein, 15 aa, Artificial Sequence
  Made in Lab - CRDH3 from anti-Fzd VH chain
CAKGSPYDWGYFDYW

SEQ ID NO: 1969 - protein, 18 aa, Artificial Sequence
  Made in Lab - CRDH3 from anti-Fzd VH chain
CARDGGLLRNYYYGMDVW

SEQ ID NO: 1970 - protein, 13 aa, Artificial Sequence
  Made in Lab - CRDH3 from anti-Fzd VH chain
CAKHWVGKGMDVW

SEQ ID NO: 1971 - protein, 21 aa, Artificial Sequence
  Made in Lab - CRDH3 from anti-Fzd VH chain
CARDGVVPAAQLYYYYGMDVW

SEQ ID NO: 1972 - protein, 16 aa, Artificial Sequence
  Made in Lab - CRDH3 from anti-Fzd VH chain
CAKGRYSGGWGDFDWW

SEQ ID NO: 1973 - protein, 16 aa, Artificial Sequence
  Made in Lab - CRDH3 from anti-Fzd VH chain
CARDIYNYYYYGMDGW

SEQ ID NO: 1974 - protein, 15 aa, Artificial Sequence
  Made in Lab - CRDH3 from anti-Fzd VH chain
CARDYSRYYYGMDVW

SEQ ID NO: 1975 - protein, 15 aa, Artificial Sequence
  Made in Lab - CRDH3 from anti-Fzd VH chain
CARESGYDWSWFDPW

SEQ ID NO: 1976 - protein, 16 aa, Artificial Sequence
  Made in Lab - CRDH3 from anti-Fzd VH chain
CARHRDNWNYDGMDVW

SEQ ID NO: 1977 - protein, 15 aa, Artificial Sequence
  Made in Lab - CRDH3 from anti-Fzd VH chain
CAKEHSGNCYAFDIW

SEQ ID NO: 1978 - protein, 15 aa, Artificial Sequence
  Made in Lab - CRDH3 from anti-Fzd VH chain
CARDSGYDWSWFDPW

SEQ ID NO: 1979 - protein, 19 aa, Artificial Sequence
  Made in Lab - CRDH3 from anti-Fzd VH chain
CARDKCNSNYCLINGMDVW

SEQ ID NO: 1980 - protein, 16 aa, Artificial Sequence
  Made in Lab - CRDH3 from anti-Fzd VH chain
CARDLSGNWYGALDYW

SEQ ID NO: 1981 - protein, 15 aa, Artificial Sequence
  Made in Lab - CRDH3 from anti-Fzd VH chain
CARDSDYDWSWFYPW

SEQ ID NO: 1982 - protein, 16 aa, Artificial Sequence
  Made in Lab - CRDH3 from anti-Fzd VH chain
CAKDRDNCYYYYLDVW

SEQ ID NO: 1983 - protein, 14 aa, Artificial Sequence
  Made in Lab - CRDH3 from anti-Fzd VH chain
CAREYSSSLVFDLW

SEQ ID NO: 1984 - protein, 20 aa, Artificial Sequence
  Made in Lab - CRDH3 from anti-Fzd VH chain
CARGPAVGASYYYYYGMDVW

SEQ ID NO: 1985 - protein, 15 aa, Artificial Sequence
  Made in Lab - CRDH3 from anti-Fzd VH chain
CARGFRDDFSFSDLW

SEQ ID NO: 1986 - protein, 15 aa, Artificial Sequence
  Made in Lab - CRDH3 from anti-Fzd VH chain
CARESGYDWSWFDPW

SEQ ID NO: 1987 - protein, 14 aa, Artificial Sequence
  Made in Lab - CRDH3 from anti-Fzd VH chain
CAREYSSSLVFDLW

SEQ ID NO: 1988 - protein, 13 aa, Artificial Sequence [sequence omitted]

SEQ ID NO: 1989 - protein, 16 aa, Artificial Sequence
  Made in Lab - CRDH3 from anti-Fzd VH chain
CARNPLYGDYGAIDYW

SEQ ID NO: 1990 - protein, 18 aa, Artificial Sequence
  Made in Lab - CRDH3 from anti-Fzd VH chain
CARDRDSDYYEWGYFDLW

SEQ ID NO: 1991 - protein, 16 aa, Artificial Sequence
  Made in Lab - CRDH3 from anti-Fzd VH chain
CARGAESSGWSQFDYW

SEQ ID NO: 1992 - protein, 15 aa, Artificial Sequence
  Made in Lab - CRDH3 from anti-Fzd VH chain
CARGGSYDFGAFDIW

SEQ ID NO: 1993 - protein, 15 aa, Artificial Sequence
  Made in Lab - CRDH3 from anti-Fzd VH chain
CARGENSDWGAFDIW

SEQ ID NO: 1994 - protein, 19 aa, Artificial Sequence
  Made in Lab - CRDH3 from anti-Fzd VH chain
CARESGYYPSTSNDAFDIW

SEQ ID NO: 1995 - protein, 16 aa, Artificial Sequence
  Made in Lab - CRDH3 from anti-Fzd VH chain
CAKGASGHDWGIFDYW

SEQ ID NO: 1996 - protein, 17 aa, Artificial Sequence
  Made in Lab - CRDH3 from anti-Fzd VH chain
CARDLVWASSGWGMDVW

SEQ ID NO: 1997 - protein, 23 aa, Artificial Sequence
  Made in Lab - CRDH3 from anti-Fzd VH chain
CARDQGWAGVPAADYYYYGMDVW

SEQ ID NO: 1998 - protein, 16 aa, Artificial Sequence
  Made in Lab - CRDH3 from anti-Fzd VH chain
CAKGWDSSGWANFDYW

SEQ ID NO: 1999 - protein, 20 aa, Artificial Sequence
  Made in Lab - CRDH3 from anti-Fzd VH chain
CARDRSSWPDYYYYYGMDVW

SEQ ID NO: 2000 - protein, 17 aa, Artificial Sequence
  Made in Lab - CRDH3 from anti-Fzd VH chain
CARDLVWASSGWGMDVW

SEQ ID NO: 2001 - protein, 16 aa, Artificial Sequence
  Made in Lab - CRDH3 from anti-Fzd VH chain
CAREAEGNQIYGMDVW

SEQ ID NO: 2002 - protein, 20 aa, Artificial Sequence
  Made in Lab - CRDH3 from anti-Fzd VH chain
CARDVTDYGDYVASWYFDLW

SEQ ID NO: 2003 - protein, 16 aa, Artificial Sequence
  Made in Lab - CRDH3 from anti-Fzd VH chain
CARDLTPDYYGAADYW

SEQ ID NO: 2004 - protein, 13 aa, Artificial Sequence
  Made in Lab - CRDH3 from anti-Fzd VH chain
CARHAEGRSADYW

SEQ ID NO: 2005 - protein, 14 aa, Artificial Sequence
  Made in Lab - CRDH3 from anti-Fzd VH chain
CAREYSSSVVFDLW

SEQ ID NO: 2006 - protein, 19 aa, Artificial Sequence
  Made in Lab - CRDH3 from anti-Fzd VH chain
CAKDKTYYDFWSGYGFDYW

SEQ ID NO: 2007 - protein, 17 aa, Artificial Sequence
  Made in Lab - CRDH3 from anti-Fzd VH chain
CAKDRVYGDYGDAFDIW

SEQ ID NO: 2008 - protein, 17 aa, Artificial Sequence
  Made in Lab - CRDH3 from anti-Fzd VH chain
CARDRDPYYYYYGMDVW

SEQ ID NO: 2009 - protein, 16 aa, Artificial Sequence
  Made in Lab - CRDH3 from anti-Fzd VH chain
CAKNPLYGDCGAFDYW

SEQ ID NO: 2010 - protein, 14 aa, Artificial Sequence
  Made in Lab - CRDH3 from anti-Fzd VH chain
CAREYSSSLVFDLW

SEQ ID NO: 2011 - protein, 11 aa, Artificial Sequence [sequence omitted]

SEQ ID NO: 2012 - protein, 16 aa, Artificial Sequence
  Made in Lab - CRDH3 from anti-Fzd VH chain
CARNPLYGDYGAIDYW

SEQ ID NO: 2013 - protein, 19 aa, Artificial Sequence
  Made in Lab - CRDH3 from anti-Fzd VH chain
CARDSSGWHPIPWGYFDLW

SEQ ID NO: 2014 - protein, 15 aa, Artificial Sequence
  Made in Lab - CRDH3 from anti-Fzd VH chain
CAREEGSGWYGMDVW

SEQ ID NO: 2015 - protein, 15 aa, Artificial Sequence
  Made in Lab - CRDH3 from anti-Fzd VH chain
CARDIDYDWSWFYPC

SEQ ID NO: 2016 - protein, 16 aa, Artificial Sequence
  Made in Lab - CRDH3 from anti-Fzd VH chain
CAKDIGASRYYYMDVW

SEQ ID NO: 2017 - protein, 20 aa, Artificial Sequence
  Made in Lab - CRDH3 from anti-Fzd VH chain
CARHKAAAAGTQYYNGMDVW

SEQ ID NO: 2018 - protein, 14 aa, Artificial Sequence
  Made in Lab - CRDH3 from anti-Fzd VH chain
CARDISWFGPMDVW

SEQ ID NO: 2019 - protein, 14 aa, Artificial Sequence
  Made in Lab - CRDH3 from anti-Fzd VH chain
CAREYSSSLVFDLW

SEQ ID NO: 2020 - protein, 15 aa, Artificial Sequence
  Made in Lab - CRDH3 from anti-Fzd VH chain
CARDSGYDWSWFYPC

SEQ ID NO: 2021 - protein, 14 aa, Artificial Sequence
  Made in Lab - CRDH3 from anti-Fzd VH chain
CAREYSSSLVFDLW

SEQ ID NO: 2022 - protein, 18 aa, Artificial Sequence
  Made in Lab - CRDH3 from anti-Fzd VH chain
CAKDLTYDFWSGWGMDVW

SEQ ID NO: 2023 - protein, 14 aa, Artificial Sequence
  Made in Lab - CRDH3 from anti-Fzd VH chain
CAREYSSSLVFDLW

SEQ ID NO: 2024 - protein, 16 aa, Artificial Sequence
  Made in Lab - CRDH3 from anti-Fzd VH chain
CARDRDRYSYGSGDYW

SEQ ID NO: 2025 - protein, 16 aa, Artificial Sequence
  Made in Lab - CRDH3 from anti-Fzd VH chain
CAKGRYSSGWGDFDYW

SEQ ID NO: 2026 - protein, 14 aa, Artificial Sequence
  Made in Lab - CRDH3 from anti-Fzd VH chain
CAREYSSSLVFDLW

SEQ ID NO: 2027 - protein, 17 aa, Artificial Sequence
  Made in Lab - CRDH3 from anti-Fzd VH chain
CARGRYYGSGSYHFDYW

SEQ ID NO: 2028 - protein, 15 aa, Artificial Sequence
  Made in Lab - CRDH3 from anti-Fzd VH chain
CARGTMTTWYLFDYW

SEQ ID NO: 2029 - protein, 15 aa, Artificial Sequence
  Made in Lab - CRDH3 from anti-Fzd VH chain
CARDSGYDWSCFYPW

SEQ ID NO: 2030 - protein, 14 aa, Artificial Sequence
  Made in Lab - CRDH3 from anti-Fzd VH chain
CAREYSSSLVFDLW

SEQ ID NO: 2031 - protein, 19 aa, Artificial Sequence
  Made in Lab - CRDH3 from anti-Fzd VH chain
CAKDKTYYDFWSGYGFDYW

SEQ ID NO: 2032 - protein, 15 aa, Artificial Sequence
  Made in Lab - CRDH3 from anti-Fzd VH chain
YSRGSGYDWSWFDPW

SEQ ID NO: 2033 - protein, 18 aa, Artificial Sequence
  Made in Lab - CRDH3 from anti-Fzd VH chain
CARGGVRGYSGYDPFDYW

SEQ ID NO: 2034 - protein, 15 aa, Artificial Sequence
  Made in Lab - CRDH3 from anti-Fzd VH chain
CARDKYLYYYGMDVW

SEQ ID NO: 2035 - protein, 18 aa, Artificial Sequence
  Made in Lab - CRDH3 from anti-Fzd VH chain
CARMGASGSGWYHWFDPW

SEQ ID NO: 2036 - protein, 16 aa, Artificial Sequence
  Made in Lab - CRDH3 from anti-Fzd VH chain
CARDMTVGNWGYFDYW

SEQ ID NO: 2037 - protein, 18 aa, Artificial Sequence
  Made in Lab - CRDH3 from anti-Fzd VH chain
CARELDDYGDYVAGFDPW

SEQ ID NO: 2038 - protein, 15 aa, Artificial Sequence
  Made in Lab - CRDH3 from anti-Fzd VH chain
CARGSGYDWSWLDPW

SEQ ID NO: 2039 - protein, 15 aa, Artificial Sequence
  Made in Lab - CRDH3 from anti-Fzd VH chain
CARDSGYDWSWFDPW

SEQ ID NO: 2040 - protein, 14 aa, Artificial Sequence
  Made in Lab - CRDH3 from anti-Fzd VH chain
CAREYSSSLVFDLW

SEQ ID NO: 2041 - protein, 18 aa, Artificial Sequence
  Made in Lab - CRDH3 from anti-Fzd VH chain
CARDSFSAAGMFGWFDPW

SEQ ID NO: 2042 - protein, 15 aa, Artificial Sequence
  Made in Lab - CRDH3 from anti-Fzd VH chain
CARGHSYDWGAFDIW

SEQ ID NO: 2043 - protein, 16 aa, Artificial Sequence
  Made in Lab - CRDH3 from anti-Fzd VH chain
CARGADSSGWSDFQHW

SEQ ID NO: 2044 - protein, 15 aa, Artificial Sequence
  Made in Lab - CRDH3 from anti-Fzd VH chain
CARDSGYDWSCYYPW

SEQ ID NO: 2045 - protein, 13 aa, Artificial Sequence
  Made in Lab - CRDH3 from anti-Fzd VH chain
CAREGYSYGYDYW

SEQ ID NO: 2046 - protein, 18 aa, Artificial Sequence
  Made in Lab - CRDH3 from anti-Fzd VH chain
CAKDLTYDFWSGWGMDVW

SEQ ID NO: 2047 - protein, 15 aa, Artificial Sequence
  Made in Lab - CRDH3 from anti-Fzd VH chain
CARDKYLYYYGMDVW

SEQ ID NO: 2048 - protein, 19 aa, Artificial Sequence
  Made in Lab - CRDH3 from anti-Fzd VH chain
CAKDQYSNYYYYYYGMDVW

SEQ ID NO: 2049 - protein, 14 aa, Artificial Sequence
  Made in Lab - CRDH3 from anti-Fzd VH chain
CARENSSSLVFDLW

SEQ ID NO: 2050 - protein, 19 aa, Artificial Sequence
  Made in Lab - CRDH3 from anti-Fzd VH chain
CAKDQYSNYYYYYYGMDVW

SEQ ID NO: 2051 - protein, 18 aa, Artificial Sequence
  Made in Lab - CRDH3 from anti-Fzd VH chain
CARDRAGDYDGWGYFDLW

SEQ ID NO: 2052 - protein, 16 aa, Artificial Sequence
  Made in Lab - CRDH3 from anti-Fzd VH chain
CARQRDNWNYDGMDVW

SEQ ID NO: 2053 - protein, 16 aa, Artificial Sequence
  Made in Lab - CRDH3 from anti-Fzd VH chain
CARGADSSGWSDFQHW

SEQ ID NO: 2054 - protein, 14 aa, Artificial Sequence
  Made in Lab - CRDH3 from anti-Fzd VH chain
CAREIAAAEYIDYW

SEQ ID NO: 2055 - protein, 15 aa, Artificial Sequence
  Made in Lab - CRDH3 from anti-Fzd VH chain
CARGSGYDWSWFDPW

SEQ ID NO: 2056 - protein, 16 aa, Artificial Sequence
  Made in Lab - CRDH3 from anti-Fzd VH chain
CARQPKGYYYYGMDVW

SEQ ID NO: 2057 - protein, 15 aa, Artificial Sequence
  Made in Lab - CRDH3 from anti-Fzd VH chain
CARDDSSGYYGMDVW

SEQ ID NO: 2058 - protein, 8 aa, Artificial Sequence
  Made in Lab - CRDH3 from anti-Fzd VH chain
CARQFEFW

SEQ ID NO: 2059 - protein, 12 aa, Artificial Sequence
  Made in Lab - CRDH3 from anti-Fzd VH chain
CVVFGSHNLDYW

SEQ ID NO: 2060 - protein, 8 aa, Artificial Sequence
  Made in Lab - CRDH3 from anti-Fzd VH chain
CAAGADVW

SEQ ID NO: 2061 - protein, 17 aa, Artificial Sequence
  Made in Lab - CRDH3 from anti-Fzd VH chain
CARDSYGDYPYNWFDPW

SEQ ID NO: 2062 - protein, 17 aa, Artificial Sequence
  Made in Lab - CRDH3 from anti-Fzd VH chain
CARGDYGDYAGNYFDYW

SEQ ID NO: 2063 - protein, 16 aa, Artificial Sequence
  Made in Lab - CRDH3 from anti-Fzd VH chain
CASGGTTYYYYGMDVW

SEQ ID NO: 2064 - protein, 11 aa, Artificial Sequence
  Made in Lab - CRDH3 from anti-Fzd VH chain
CARVGGGMDVW

SEQ ID NO: 2065 - protein, 14 aa, Artificial Sequence
  Made in Lab - CRDH3 from anti-Fzd VH chain
CARDEDGSGWLDYW

SEQ ID NO: 2066 - protein, 16 aa, Artificial Sequence
  Made in Lab - CRDH3 from anti-Fzd VH chain
CARGGSYYVDYGMDVW

SEQ ID NO: 2067 - protein, 9 aa, Artificial Sequence
  Made in Lab - CRDH3 from anti-Fzd VH chain
CTTDGMDVW

SEQ ID NO: 2068 - protein, 11 aa, Artificial Sequence [sequence omitted]

SEQ ID NO: 2069 - protein, 13 aa, Artificial Sequence
  Made in Lab - CRDH3 from anti-Fzd VH chain
CARGGSYQAFDYW

SEQ ID NO: 2070 - protein, 24 aa, Artificial Sequence
  Made in Lab - CRDH3 from anti-Fzd VH chain
CARDGYDFWSGYPNYYYYYGMDVW

SEQ ID NO: 2071 - protein, 18 aa, Artificial Sequence
  Made in Lab - CRDH3 from anti-Fzd VH chain
CARDGRTGTRYYYYMDVW

SEQ ID NO: 2072 - protein, 12 aa, Artificial Sequence
  Made in Lab - CRDH3 from anti-Fzd VH chain
CARDPLYGMDVW

SEQ ID NO: 2073 - protein, 19 aa, Artificial Sequence
  Made in Lab - CRDH3 from anti-Fzd VH chain
CARENYGDDDYYYYGMDVW

SEQ ID NO: 2074 - protein, 14 aa, Artificial Sequence
  Made in Lab - CRDH3 from anti-Fzd VH chain
CARQENHYYGMDVW

SEQ ID NO: 2075 - protein, 14 aa, Artificial Sequence
  Made in Lab - CRDH3 from anti-Fzd VH chain
CARMYSSSDGMDVW

SEQ ID NO: 2076 - protein, 15 aa, Artificial Sequence
  Made in Lab - CRDH3 from anti-Fzd VH chain
CARNIAAAAYGMDVW

SEQ ID NO: 2077 - protein, 15 aa, Artificial Sequence
  Made in Lab - CRDH3 from anti-Fzd VH chain
CARSIAAAAYGMDVW

SEQ ID NO: 2078 - protein, 25 aa, Artificial Sequence
  Made in Lab - CRDH3 from anti-Fzd VH chain
CARDPGFHYGSGSYYNVSVGWFDPW

SEQ ID NO: 2079 - protein, 15 aa, Artificial Sequence
  Made in Lab - CRDH3 from anti-Fzd VH chain
CARSGYSGYDPFDYW

SEQ ID NO: 2080 - protein, 19 aa, Artificial Sequence
  Made in Lab - CRDH3 from anti-Fzd VH chain
CARVGITGTTGDYYGMDVW

SEQ ID NO: 2081 - protein, 8 aa, Artificial Sequence [sequence omitted]

SEQ ID NO: 2082 - protein, 15 aa, Artificial Sequence
  Made in Lab - CRDH3 from anti-Fzd VH chain
CARGNSAVAYGMDVW

SEQ ID NO: 2083 - protein, 14 aa, Artificial Sequence
  Made in Lab - CRDH3 from anti-Fzd VH chain
CASEVLGAEYFQIW

SEQ ID NO: 2084 - protein, 21 aa, Artificial Sequence
  Made in Lab - CRDH3 from anti-Fzd VH chain
CARDLEQLADKYYYYYGMDVW

SEQ ID NO: 2085 - protein, 16 aa, Artificial Sequence
  Made in Lab - CRDH3 from anti-Fzd VH chain
CATEPRWAAGRAFDIW

SEQ ID NO: 2086 - protein, 14 aa, Artificial Sequence
  Made in Lab - CRDH3 from anti-Fzd VH chain
CARMYGSGYGMDVW

SEQ ID NO: 2087 - protein, 20 aa, Artificial Sequence
  Made in Lab - CRDH3 from anti-Fzd VH chain
CARPPVCYSGYDCPYYFDYW

SEQ ID NO: 2088 - protein, 13 aa, Artificial Sequence
  Made in Lab - CRDH3 from anti-Fzd VH chain
CARDHAVYGMDVW

SEQ ID NO: 2089 - protein, 13 aa, Artificial Sequence [sequence omitted]

SEQ ID NO: 2090 - protein, 9 aa, Artificial Sequence
  Made in Lab - CRDH3 from anti-Fzd VH chain
CASVDEGYW

SEQ ID NO: 2091 - protein, 15 aa, Artificial Sequence
  Made in Lab - CRDH3 from anti-Fzd VH chain
CTSADAYYYYGMDVW

SEQ ID NO: 2092 - protein, 10 aa, Artificial Sequence
  Made in Lab - CRDH3 from anti-Fzd VH chain
CVLEGRVQHW

SEQ ID NO: 2093 - protein, 11 aa, Artificial Sequence [sequence omitted]

SEQ ID NO: 2094 - protein, 12 aa, Artificial Sequence
  Made in Lab - CRDH3 from anti-Fzd VH chain
CARDYYGSLDFW

SEQ ID NO: 2095 - protein, 10 aa, Artificial Sequence
  Made in Lab - CRDH3 from anti-Fzd VH chain
CARDRVVNDW

SEQ ID NO: 2096 - protein, 19 aa, Artificial Sequence
  Made in Lab - CRDH3 from anti-Fzd VH chain
CARQVPSSSAHYYYGMDVW

SEQ ID NO: 2097 - protein, 11 aa, Artificial Sequence
  Made in Lab - CRDH3 from anti-Fzd VH chain
CARAYYGFDYW

SEQ ID NO: 2098 - protein, 12 aa, Artificial Sequence [sequence omitted]

SEQ ID NO: 2099 - protein, 19 aa, Artificial Sequence
  Made in Lab - CRDH3 from anti-Fzd VH chain
CARWNEGFGVVTGDYFDYW

SEQ ID NO: 2100 - protein, 13 aa, Artificial Sequence
  Made in Lab - CRDH3 from anti-Fzd VH chain
CAREGGDYIFDYW

SEQ ID NO: 2101 - protein, 17 aa, Artificial Sequence
  Made in Lab - CRDH3 from anti-Fzd VH chain
CATGYCSGGSCYLTGYW

SEQ ID NO: 2102 - protein, 16 aa, Artificial Sequence
  Made in Lab - CRDH3 from anti-Fzd VH chain
CARDPGNYYYYGMDVW

SEQ ID NO: 2103 - protein, 17 aa, Artificial Sequence
  Made in Lab - CRDH3 from anti-Fzd VH chain
CARVGSGYDFFYYMDVW

SEQ ID NO: 2104 - protein, 15 aa, Artificial Sequence
  Made in Lab - CRDH3 from anti-Fzd VH chain
CARESGDYDEALDYW

SEQ ID NO: 2105 - protein, 9 aa, Artificial Sequence
  Made in Lab - CRDH3 from anti-Fzd VH chain
CTTDRGDLW

SEQ ID NO: 2106 - protein, 12 aa, Artificial Sequence
  Made in Lab - CRDH3 from anti-Fzd VH chain
CARAYNSWFDPW

SEQ ID NO: 2107 - protein, 13 aa, Artificial Sequence
  Made in Lab - CRDH3 from anti-Fzd VH chain
CARDHDDYGMDVW

SEQ ID NO: 2108 - protein, 13 aa, Artificial Sequence
  Made in Lab - CRDH3 from anti-Fzd VH chain
CARDGDYYGMDAW

SEQ ID NO: 2109 - protein, 7 aa, Artificial Sequence [sequence omitted]

SEQ ID NO: 2110 - protein, 13 aa, Artificial Sequence
  Made in Lab - CRDH3 from anti-Fzd VH chain
CATAIREDGFDYW

SEQ ID NO: 2111 - protein, 18 aa, Artificial Sequence
  Made in Lab - CRDH3 from anti-Fzd VH chain
CAKGRAYYYDSSGLLPDW

SEQ ID NO: 2112 - protein, 16 aa, Artificial Sequence
  Made in Lab - CRDH3 from anti-Fzd VH chain
CARVRPYYYYYGMDVW

SEQ ID NO: 2113 - protein, 13 aa, Artificial Sequence
  Made in Lab - CRDH3 from anti-Fzd VH chain
CARGRLGGYFDLW

SEQ ID NO: 2114 - protein, 7 aa, Artificial Sequence
  Made in Lab - CRDH3 from anti-Fzd VH chain
CTTADYW

SEQ ID NO: 2115 - protein, 14 aa, Artificial Sequence
  Made in Lab - CRDH3 from anti-Fzd VH chain
CARMYSSSDGMDVW

SEQ ID NO: 2116 - protein, 22 aa, Artificial Sequence
  Made in Lab - CRDH3 from anti-Fzd VH chain
CARDGWEQHARSGYYYYGMDVW

SEQ ID NO: 2117 - protein, 16 aa, Artificial Sequence
  Made in Lab - CRDH3 from anti-Fzd VH chain
CARDPGNYYYYGMDVW

SEQ ID NO: 2118 - protein, 11 aa, Artificial Sequence
  Made in Lab - CRDH3 from anti-Fzd VH chain
CTTDYGWLGYW

SEQ ID NO: 2119 - protein, 13 aa, Artificial Sequence
  Made in Lab - CRDH3 from anti-Fzd VH chain
CARDHDYYGMDVW

SEQ ID NO: 2120 - protein, 11 aa, Artificial Sequence
  Made in Lab - CRDH3 from anti-Fzd VH chain
CVRGGYDFDSW

SEQ ID NO: 2121 - protein, 15 aa, Artificial Sequence
  Made in Lab - CRDH3 from anti-Fzd VH chain
CARDGGKNGWHFDYW

SEQ ID NO: 2122 - protein, 11 aa, Artificial Sequence
  Made in Lab - CRDL1 from anti-Fzd VL chain
QASEDISNYLH

SEQ ID NO: 2123 - protein, 11 aa, Artificial Sequence
  Made in Lab - CRDL1 from anti-Fzd VL chain
RASQGIGNSLA

SEQ ID NO: 2124 - protein, 16 aa, Artificial Sequence
  Made in Lab - CRDL1 from anti-Fzd VL chain
RSSQSLLHSNGYNYLD

SEQ ID NO: 2125 - protein, 16 aa, Artificial Sequence
  Made in Lab - CRDL1 from anti-Fzd VL chain
RSSQSLLHSNGYNYLD

SEQ ID NO: 2126 - protein, 16 aa, Artificial Sequence
  Made in Lab - CRDL1 from anti-Fzd VL chain
RSSQSLLHSNGYNYLD

SEQ ID NO: 2127 - protein, 16 aa, Artificial Sequence
  Made in Lab - CRDL1 from anti-Fzd VL chain
RSSQSLLHSNGYNYLD

SEQ ID NO: 2128 - protein, 16 aa, Artificial Sequence
  Made in Lab - CRDL1 from anti-Fzd VL chain
RSSQSLLHSNGYNYLD

SEQ ID NO: 2129 - protein, 16 aa, Artificial Sequence
  Made in Lab - CRDL1 from anti-Fzd VL chain
RSSQSLLHSNGYNYLD

SEQ ID NO: 2130 - protein, 16 aa, Artificial Sequence
  Made in Lab - CRDL1 from anti-Fzd VL chain
RSSQSLLHSNGYNYLD

SEQ ID NO: 2131 - protein, 16 aa, Artificial Sequence
  Made in Lab - CRDL1 from anti-Fzd VL chain
RSSQSLLHSNGYNYLD

SEQ ID NO: 2132 - protein, 16 aa, Artificial Sequence
  Made in Lab - CRDL1 from anti-Fzd VL chain
RSSQSLLHSNGYNYLD

SEQ ID NO: 2133 - protein, 16 aa, Artificial Sequence
  Made in Lab - CRDL1 from anti-Fzd VL chain
RSSQSLLHSNGYNYLD

SEQ ID NO: 2134 - protein, 16 aa, Artificial Sequence
  Made in Lab - CRDL1 from anti-Fzd VL chain
RSSQSLLHSNGYNYLD

SEQ ID NO: 2135 - protein, 16 aa, Artificial Sequence
  Made in Lab - CRDL1 from anti-Fzd VL chain
RSSQSLLHSNGYNYLD

SEQ ID NO: 2136 - protein, 16 aa, Artificial Sequence
  Made in Lab - CRDL1 from anti-Fzd VL chain
RSSQSLLHSNGYNYLD

SEQ ID NO: 2137 - protein, 11 aa, Artificial Sequence
  Made in Lab - CRDL1 from anti-Fzd VL chain
QASQDIRNYLN

SEQ ID NO: 2138 - protein, 16 aa, Artificial Sequence
  Made in Lab - CRDL1 from anti-Fzd VL chain
RSSQSLLHSNGYNYLD

SEQ ID NO: 2139 - protein, 16 aa, Artificial Sequence
  Made in Lab - CRDL1 from anti-Fzd VL chain
RSSQSLLHSNGYNYLD

SEQ ID NO: 2140 - protein, 16 aa, Artificial Sequence
  Made in Lab - CRDL1 from anti-Fzd VL chain
RSSESLLHRNGYNYLD

SEQ ID NO: 2141 - protein, 16 aa, Artificial Sequence
  Made in Lab - CRDL1 from anti-Fzd VL chain
RSSQSLLHSNGYNYLD

SEQ ID NO: 2142 - protein, 16 aa, Artificial Sequence
  Made in Lab - CRDL1 from anti-Fzd VL chain
RSSQSLLHSNGYNYLD

SEQ ID NO: 2143 - protein, 16 aa, Artificial Sequence
  Made in Lab - CRDL1 from anti-Fzd VL chain
RSSQSLLHSNGYNYLD

SEQ ID NO: 2144 - protein, 16 aa, Artificial Sequence
  Made in Lab - CRDL1 from anti-Fzd VL chain
RSSQSLLHSNGYNYLD

SEQ ID NO: 2145 - protein, 16 aa, Artificial Sequence
  Made in Lab - CRDL1 from anti-Fzd VL chain
RSSQSLLHSNGYNYLD

SEQ ID NO: 2146 - protein, 16 aa, Artificial Sequence
  Made in Lab - CRDL1 from anti-Fzd VL chain
RSSQSLLHSNGYNYLD

SEQ ID NO: 2147 - protein, 16 aa, Artificial Sequence
  Made in Lab - CRDL1 from anti-Fzd VL chain
RSSQSLLHSNGYNYLD

SEQ ID NO: 2148 - protein, 16 aa, Artificial Sequence
  Made in Lab - CRDL1 from anti-Fzd VL chain
RSSZSLLHSNGYNYLD

SEQ ID NO: 2149 - protein, 16 aa, Artificial Sequence
  Made in Lab - CRDL1 from anti-Fzd VL chain
RSSQSLLHSNGYNYLD

SEQ ID NO: 2150 - protein, 16 aa, Artificial Sequence
  Made in Lab - CRDL1 from anti-Fzd VL chain
RSSQSLLHSNGYNYLD

SEQ ID NO: 2151 - protein, 16 aa, Artificial Sequence
  Made in Lab - CRDL1 from anti-Fzd VL chain
RSSQSLLNNNGNTYID

SEQ ID NO: 2152 - protein, 11 aa, Artificial Sequence
  Made in Lab - CRDL1 from anti-Fzd VL chain
QASQSIYNYLN

SEQ ID NO: 2153 - protein, 11 aa, Artificial Sequence
  Made in Lab - CRDL1 from anti-Fzd VL chain
RASQSISSWLA

SEQ ID NO: 2154 - protein, 16 aa, Artificial Sequence
  Made in Lab - CRDL1 from anti-Fzd VL chain
RSSQSLLHSNGYNYLD

SEQ ID NO: 2155 - protein, 11 aa, Artificial Sequence
  Made in Lab - CRDL1 from anti-Fzd VL chain
QASQDISNDLN

SEQ ID NO: 2156 - protein, 11 aa, Artificial Sequence
  Made in Lab - CRDL1 from anti-Fzd VL chain
RASQSINKWLA

SEQ ID NO: 2157 - protein, 16 aa, Artificial Sequence
  Made in Lab - CRDL1 from anti-Fzd VL chain
RSSQSLLHSNGYNYLD

SEQ ID NO: 2158 - protein, 11 aa, Artificial Sequence
  Made in Lab - CRDL1 from anti-Fzd VL chain
QASQDISNYLN

SEQ ID NO: 2159 - protein, 11 aa, Artificial Sequence
  Made in Lab - CRDL1 from anti-Fzd VL chain
QASQDIRNYLN

SEQ ID NO: 2160 - protein, 16 aa, Artificial Sequence
  Made in Lab - CRDL1 from anti-Fzd VL chain
RSSQSLLHSNGYNYLD

SEQ ID NO: 2161 - protein, 11 aa, Artificial Sequence
  Made in Lab - CRDL1 from anti-Fzd VL chain
RASQDISNYLN

SEQ ID NO: 2162 - protein, 11 aa, Artificial Sequence
  Made in Lab - CRDL1 from anti-Fzd VL chain
RASQDISNYLN

SEQ ID NO: 2163 - protein, 11 aa, Artificial Sequence
  Made in Lab - CRDL1 from anti-Fzd VL chain
RASQGISNNLN

SEQ ID NO: 2164 - protein, 11 aa, Artificial Sequence
  Made in Lab - CRDL1 from anti-Fzd VL chain
RSSQTINZYLN

SEQ ID NO: 2165 - protein, 11 aa, Artificial Sequence
  Made in Lab - CRDL1 from anti-Fzd VL chain
RASQSVSSYVN

SEQ ID NO: 2166 - protein, 16 aa, Artificial Sequence
  Made in Lab - CRDL1 from anti-Fzd VL chain
RSSQSLLHSNGYNYLD

SEQ ID NO: 2167 - protein, 12 aa, Artificial Sequence
  Made in Lab - CRDL1 from anti-Fzd VL chain
RASQSVSGSYLA

SEQ ID NO: 2168 - protein, 11 aa, Artificial Sequence
  Made in Lab - CRDL1 from anti-Fzd VL chain
RASQGISSWLA

SEQ ID NO: 2169 - protein, 16 aa, Artificial Sequence
  Made in Lab - CRDL1 from anti-Fzd VL chain
RSSQSLLHSNGYNYLD

SEQ ID NO: 2170 - protein, 11 aa, Artificial Sequence
  Made in Lab - CRDL1 from anti-Fzd VL chain
RASERISQYLN

SEQ ID NO: 2171 - protein, 12 aa, Artificial Sequence
  Made in Lab - CRDL1 from anti-Fzd VL chain
ZZZQSVZGNYLZ

SEQ ID NO: 2172 - protein, 12 aa, Artificial Sequence
  Made in Lab - CRDL1 from anti-Fzd VL chain
RASQSVSSSYLZ

SEQ ID NO: 2173 - protein, 12 aa, Artificial Sequence
  Made in Lab - CRDL1 from anti-Fzd VL chain
RASQSVSSSYLA

SEQ ID NO: 2174 - protein, 16 aa, Artificial Sequence
  Made in Lab - CRDL1 from anti-Fzd VL chain
RSSQSLLHSNGYNYLD

SEQ ID NO: 2175 - protein, 16 aa, Artificial Sequence
  Made in Lab - CRDL1 from anti-Fzd VL chain
RSSQSLLHSNGYNYLD

SEQ ID NO: 2176 - protein, 16 aa, Artificial Sequence
  Made in Lab - CRDL1 from anti-Fzd VL chain
RSSQSLLHSNGYNYLD

SEQ ID NO: 2177 - protein, 16 aa, Artificial Sequence
  Made in Lab - CRDL1 from anti-Fzd VL chain
RSSQSLLHSNGYNYLD

SEQ ID NO: 2178 - protein, 16 aa, Artificial Sequence
  Made in Lab - CRDL1 from anti-Fzd VL chain
RSSQSLLHSNGYNYLD

SEQ ID NO: 2179 - protein, 16 aa, Artificial Sequence
  Made in Lab - CRDL1 from anti-Fzd VL chain
RSSQSZZHSNGYNYLD

SEQ ID NO: 2180 - protein, 12 aa, Artificial Sequence
  Made in Lab - CRDL1 from anti-Fzd VL chain
RASQSVSSNYLA

SEQ ID NO: 2181 - protein, 11 aa, Artificial Sequence
  Made in Lab - CRDL1 from anti-Fzd VL chain
RASERISQYLN

SEQ ID NO: 2182 - protein, 12 aa, Artificial Sequence
  Made in Lab - CRDL1 from anti-Fzd VL chain
RASQRVNTNYLA

SEQ ID NO: 2183 - protein, 16 aa, Artificial Sequence
  Made in Lab - CRDL1 from anti-Fzd VL chain
RZZQSLPPSNGYNYLD

SEQ ID NO: 2184 - protein, 16 aa, Artificial Sequence
  Made in Lab - CRDL1 from anti-Fzd VL chain
RSSQSLLYSNGYTYVD

SEQ ID NO: 2185 - protein, 11 aa, Artificial Sequence
  Made in Lab - CRDL1 from anti-Fzd VL chain
QASQDIRTDLH

SEQ ID NO: 2186 - protein, 11 aa, Artificial Sequence
  Made in Lab - CRDL1 from anti-Fzd VL chain
RASERISQYLN

SEQ ID NO: 2187 - protein, 16 aa, Artificial Sequence
  Made in Lab - CRDL1 from anti-Fzd VL chain
RSSQSLLHSNGYTYLD

SEQ ID NO: 2188 - protein, 16 aa, Artificial Sequence
  Made in Lab - CRDL1 from anti-Fzd VL chain
RSSQSLLYTNGLTYVD

SEQ ID NO: 2189 - protein, 16 aa, Artificial Sequence
  Made in Lab - CRDL1 from anti-Fzd VL chain
RSSQSLLHSNGYNYLD

SEQ ID NO: 2190 - protein, 11 aa, Artificial Sequence
  Made in Lab - CRDL1 from anti-Fzd VL chain
RASQDIKNDLG

SEQ ID NO: 2191 - protein, 16 aa, Artificial Sequence
  Made in Lab - CRDL1 from anti-Fzd VL chain
RSSQSLLFTNGHNYLD

SEQ ID NO: 2192 - protein, 16 aa, Artificial Sequence
  Made in Lab - CRDL1 from anti-Fzd VL chain
RSSQSLLHSNGYNYLD

SEQ ID NO: 2193 - protein, 16 aa, Artificial Sequence
  Made in Lab - CRDL1 from anti-Fzd VL chain
RSSQSLZHSNGYKYLD

SEQ ID NO: 2194 - protein, 16 aa, Artificial Sequence
  Made in Lab - CRDL1 from anti-Fzd VL chain
RSSQSLLHSNGYNYLD

SEQ ID NO: 2195 - protein, 11 aa, Artificial Sequence
  Made in Lab - CRDL1 from anti-Fzd VL chain
RASERISQYLN

SEQ ID NO: 2196 - protein, 16 aa, Artificial Sequence
  Made in Lab - CRDL1 from anti-Fzd VL chain
RSSQSLLHSNGYNYLD

SEQ ID NO: 2197 - protein, 12 aa, Artificial Sequence
  Made in Lab - CRDL1 from anti-Fzd VL chain
RASQSVSSSYLA

SEQ ID NO: 2198 - protein, 11 aa, Artificial Sequence
  Made in Lab - CRDL1 from anti-Fzd VL chain
RASQGISSYLN

SEQ ID NO: 2199 - protein, 16 aa, Artificial Sequence
  Made in Lab - CRDL1 from anti-Fzd VL chain
RSSQSLLHSNGYNYLD

SEQ ID NO: 2200 - protein, 17 aa, Artificial Sequence
  Made in Lab - CRDL1 from anti-Fzd VL chain
KSSQSVLYSSNNKNYLA

SEQ ID NO: 2201 - protein, 16 aa, Artificial Sequence
  Made in Lab - CRDL1 from anti-Fzd VL chain
RSSQSLLHSNGYNYLD

SEQ ID NO: 2202 - protein, 12 aa, Artificial Sequence
  Made in Lab - CRDL1 from anti-Fzd VL chain
RASQSVSSSYLA

SEQ ID NO: 2203 - protein, 16 aa, Artificial Sequence
  Made in Lab - CRDL1 from anti-Fzd VL chain
RSSQSLLHSNGYNYLD

SEQ ID NO: 2204 - protein, 11 aa, Artificial Sequence
  Made in Lab - CRDL1 from anti-Fzd VL chain
RASQGISNYLN

SEQ ID NO: 2205 - protein, 16 aa, Artificial Sequence
  Made in Lab - CRDL1 from anti-Fzd VL chain
RSSQSLLHSNGYNYLD

SEQ ID NO: 2206 - protein, 11 aa, Artificial Sequence
  Made in Lab - CRDL1 from anti-Fzd VL chain
RASQSISSYLN

SEQ ID NO: 2207 - protein, 12 aa, Artificial Sequence
  Made in Lab - CRDL1 from anti-Fzd VL chain
RASQTITSNYLA

SEQ ID NO: 2208 - protein, 11 aa, Artificial Sequence
  Made in Lab - CRDL1 from anti-Fzd VL chain
RASQSISSYLN

SEQ ID NO: 2209 - protein, 16 aa, Artificial Sequence
  Made in Lab - CRDL1 from anti-Fzd VL chain
RSSQSLLHSNGYNYLD

SEQ ID NO: 2210 - protein, 16 aa, Artificial Sequence
  Made in Lab - CRDL1 from anti-Fzd VL chain
RSSQSLLHSNGYNYLD

SEQ ID NO: 2211 - protein, 17 aa, Artificial Sequence
  Made in Lab - CRDL1 from anti-Fzd VL chain
KSSQSVLYTSNNKNYLA

SEQ ID NO: 2212 - protein, 11 aa, Artificial Sequence
  Made in Lab - CRDL1 from anti-Fzd VL chain
QASQNZZTFLN

SEQ ID NO: 2213 - protein, 11 aa, Artificial Sequence
  Made in Lab - CRDL1 from anti-Fzd VL chain
QASQDISNYLN

SEQ ID NO: 2214 - protein, 11 aa, Artificial Sequence
  Made in Lab - CRDL1 from anti-Fzd VL chain
RASQNIDKWLA

SEQ ID NO: 2215 - protein, 11 aa, Artificial Sequence
  Made in Lab - CRDL1 from anti-Fzd VL chain
RASQGISNYLA

SEQ ID NO: 2216 - protein, 12 aa, Artificial Sequence
  Made in Lab - CRDL1 from anti-Fzd VL chain
RASQTVGTTYLA

SEQ ID NO: 2217 - protein, 16 aa, Artificial Sequence
  Made in Lab - CRDL1 from anti-Fzd VL chain
RSSQSLLHSNGYNYLD

SEQ ID NO: 2218 - protein, 11 aa, Artificial Sequence
  Made in Lab - CRDL1 from anti-Fzd VL chain
RASQRIGTYLN

SEQ ID NO: 2219 - protein, 17 aa, Artificial Sequence
  Made in Lab - CRDL1 from anti-Fzd VL chain
KSSQSVLYSSNNKNYLA

SEQ ID NO: 2220 - protein, 11 aa, Artificial Sequence
  Made in Lab - CRDL1 from anti-Fzd VL chain
RASQGISSWLA

SEQ ID NO: 2221 - protein, 11 aa, Artificial Sequence
  Made in Lab - CRDL1 from anti-Fzd VL chain
QASQDIRKYLN

SEQ ID NO: 2222 - protein, 11 aa, Artificial Sequence
  Made in Lab - CRDL1 from anti-Fzd VL chain
RASQSISRYLH

SEQ ID NO: 2223 - protein, 16 aa, Artificial Sequence
  Made in Lab - CRDL1 from anti-Fzd VL chain
RSSQSLLHSNGYNYLD

SEQ ID NO: 2224 - protein, 17 aa, Artificial Sequence
  Made in Lab - CRDL1 from anti-Fzd VL chain
KSSQSVLYSSNNKNYLA

SEQ ID NO: 2225 - protein, 11 aa, Artificial Sequence
  Made in Lab - CRDL1 from anti-Fzd VL chain
RASQSISSHLN

SEQ ID NO: 2226 - protein, 11 aa, Artificial Sequence
  Made in Lab - CRDL1 from anti-Fzd VL chain
RASQSISSYLN

SEQ ID NO: 2227 - protein, 11 aa, Artificial Sequence
  Made in Lab - CRDL1 from anti-Fzd VL chain
QASQDINNYLN

SEQ ID NO: 2228 - protein, 11 aa, Artificial Sequence
  Made in Lab - CRDL1 from anti-Fzd VL chain
RASQNIKRYLN

SEQ ID NO: 2229 - protein, 11 aa, Artificial Sequence
  Made in Lab - CRDL1 from anti-Fzd VL chain
RASQSISNNLN

SEQ ID NO: 2230 - protein, 11 aa, Artificial Sequence
  Made in Lab - CRDL1 from anti-Fzd VL chain
RASQSIGSYLN

SEQ ID NO: 2231 - protein, 11 aa, Artificial Sequence
  Made in Lab - CRDL1 from anti-Fzd VL chain
QASQDISNYLN

SEQ ID NO: 2232 - protein, 17 aa, Artificial Sequence
  Made in Lab - CRDL1 from anti-Fzd VL chain
KSSQSVFYNSNNKNYLA

SEQ ID NO: 2233 - protein, 11 aa, Artificial Sequence
  Made in Lab - CRDL1 from anti-Fzd VL chain
RASQGIGNYLA

SEQ ID NO: 2234 - protein, 16 aa, Artificial Sequence
  Made in Lab - CRDL1 from anti-Fzd VL chain
RSSQSLLHSNGYNYLD

SEQ ID NO: 2235 - protein, 16 aa, Artificial Sequence
  Made in Lab - CRDL1 from anti-Fzd VL chain
RSSQSLLHSNGYNYVD

SEQ ID NO: 2236 - protein, 11 aa, Artificial Sequence
  Made in Lab - CRDL1 from anti-Fzd VL chain
RASQSISSYLN

SEQ ID NO: 2237 - protein, 11 aa, Artificial Sequence
  Made in Lab - CRDL1 from anti-Fzd VL chain
QASQDISNYLN

SEQ ID NO: 2238 - protein, 11 aa, Artificial Sequence
  Made in Lab - CRDL1 from anti-Fzd VL chain
RASQAINSYLA

SEQ ID NO: 2239 - protein, 16 aa, Artificial Sequence
  Made in Lab - CRDL1 from anti-Fzd VL chain
RSSQSLLHSNGYNYLD

SEQ ID NO: 2240 - protein, 17 aa, Artificial Sequence
  Made in Lab - CRDL1 from anti-Fzd VL chain
KSSQSVLYSSNNKNYLA

SEQ ID NO: 2241 - protein, 11 aa, Artificial Sequence
  Made in Lab - CRDL1 from anti-Fzd VL chain
RASQGISNYLA

SEQ ID NO: 2242 - protein, 11 aa, Artificial Sequence
  Made in Lab - CRDL1 from anti-Fzd VL chain
RASQSISSYLN

SEQ ID NO: 2243 - protein, 16 aa, Artificial Sequence
  Made in Lab - CRDL1 from anti-Fzd VL chain
RSSQSLLHSNGYNYLD

SEQ ID NO: 2244 - protein, 11 aa, Artificial Sequence
  Made in Lab - CRDL1 from anti-Fzd VL chain
RASQGIRNDLG

SEQ ID NO: 2245 - protein, 11 aa, Artificial Sequence
  Made in Lab - CRDL1 from anti-Fzd VL chain
RASQHINRYLN

SEQ ID NO: 2246 - protein, 11 aa, Artificial Sequence
  Made in Lab - CRDL1 from anti-Fzd VL chain
RASQGISSWLA

SEQ ID NO: 2247 - protein, 16 aa, Artificial Sequence
  Made in Lab - CRDL1 from anti-Fzd VL chain
RSSQSLLHSNGYNYLD

SEQ ID NO: 2248 - protein, 11 aa, Artificial Sequence
  Made in Lab - CRDL1 from anti-Fzd VL chain
QASQDISNYLN

SEQ ID NO: 2249 - protein, 16 aa, Artificial Sequence
  Made in Lab - CRDL1 from anti-Fzd VL chain
RSSQSLLHSNGYNYLD

SEQ ID NO: 2250 - protein, 11 aa, Artificial Sequence
  Made in Lab - CRDL1 from anti-Fzd VL chain
RASQTISDYLN

SEQ ID NO: 2251 - protein, 16 aa, Artificial Sequence
  Made in Lab - CRDL1 from anti-Fzd VL chain
RSSQSLLHSNGYNYLD

SEQ ID NO: 2252 - protein, 11 aa, Artificial Sequence
  Made in Lab - CRDL1 from anti-Fzd VL chain
RASQGIRSDLG

SEQ ID NO: 2253 - protein, 16 aa, Artificial Sequence
  Made in Lab - CRDL1 from anti-Fzd VL chain
RSSQSLLHSNGYNYLD

SEQ ID NO: 2254 - protein, 11 aa, Artificial Sequence
  Made in Lab - CRDL1 from anti-Fzd VL chain
RASQSISSYLN

SEQ ID NO: 2255 - protein, 12 aa, Artificial Sequence
  Made in Lab - CRDL1 from anti-Fzd VL chain
RASLSVTNNYLA

SEQ ID NO: 2256 - protein, 16 aa, Artificial Sequence
  Made in Lab - CRDL1 from anti-Fzd VL chain
RSSQSLLHSNGYNYLD

SEQ ID NO: 2257 - protein, 11 aa, Artificial Sequence
  Made in Lab - CRDL1 from anti-Fzd VL chain
RASQGISSYLA

SEQ ID NO: 2258 - protein, 11 aa, Artificial Sequence
  Made in Lab - CRDL1 from anti-Fzd VL chain
RASQSISSYLN

SEQ ID NO: 2259 - protein, 11 aa, Artificial Sequence
  Made in Lab - CRDL1 from anti-Fzd VL chain
RASQSISSYLN

SEQ ID NO: 2260 - protein, 11 aa, Artificial Sequence
  Made in Lab - CRDL1 from anti-Fzd VL chain
QASQDISNYLN

SEQ ID NO: 2261 - protein, 11 aa, Artificial Sequence
  Made in Lab - CRDL1 from anti-Fzd VL chain
RASQSISSYLN

SEQ ID NO: 2262 - protein, 11 aa, Artificial Sequence
  Made in Lab - CRDL1 from anti-Fzd VL chain
RASQDISNYLN

SEQ ID NO: 2263 - protein, 11 aa, Artificial Sequence
  Made in Lab - CRDL1 from anti-Fzd VL chain
RASQGISNYLA

SEQ ID NO: 2264 - protein, 11 aa, Artificial Sequence
  Made in Lab - CRDL1 from anti-Fzd VL chain
RASQSISKWLA

SEQ ID NO: 2265 - protein, 17 aa, Artificial Sequence
  Made in Lab - CRDL1 from anti-Fzd VL chain
KSSQSVLYSSNNKNYLA

SEQ ID NO: 2266 - protein, 11 aa, Artificial Sequence
  Made in Lab - CRDL1 from anti-Fzd VL chain
RASQSISSYLN

SEQ ID NO: 2267 - protein, 11 aa, Artificial Sequence
  Made in Lab - CRDL1 from anti-Fzd VL chain
QASQGINNYLN

SEQ ID NO: 2268 - protein, 11 aa, Artificial Sequence
  Made in Lab - CRDL1 from anti-Fzd VL chain
RASQNIGSYLN

SEQ ID NO: 2269 - protein, 11 aa, Artificial Sequence
  Made in Lab - CRDL1 from anti-Fzd VL chain
RASQNIGSWLA

SEQ ID NO: 2270 - protein, 11 aa, Artificial Sequence
  Made in Lab - CRDL1 from anti-Fzd VL chain
QASQDISNYLN

SEQ ID NO: 2271 - protein, 16 aa, Artificial Sequence
  Made in Lab - CRDL1 from anti-Fzd VL chain
RSSQSLLHSNGYNYLD

SEQ ID NO: 2272 - protein, 16 aa, Artificial Sequence
  Made in Lab - CRDL1 from anti-Fzd VL chain
RSSQSLLHSNGYNYLD

SEQ ID NO: 2273 - protein, 16 aa, Artificial Sequence
  Made in Lab - CRDL1 from anti-Fzd VL chain
RSSQSLLHSNGYNYLD

SEQ ID NO: 2274 - protein, 11 aa, Artificial Sequence
  Made in Lab - CRDL1 from anti-Fzd VL chain
RASQSISRWLA

SEQ ID NO: 2275 - protein, 11 aa, Artificial Sequence
  Made in Lab - CRDL1 from anti-Fzd VL chain
RASQGISNYLA

SEQ ID NO: 2276 - protein, 12 aa, Artificial Sequence
  Made in Lab - CRDL1 from anti-Fzd VL chain
RASQSVSSSYLA

SEQ ID NO: 2277 - protein, 11 aa, Artificial Sequence
  Made in Lab - CRDL1 from anti-Fzd VL chain
RASQYISNYLN

SEQ ID NO: 2278 - protein, 11 aa, Artificial Sequence
  Made in Lab - CRDL1 from anti-Fzd VL chain
RASQDISNYLN

SEQ ID NO: 2279 - protein, 16 aa, Artificial Sequence
  Made in Lab - CRDL1 from anti-Fzd VL chain
RSSQSLLHSNGYNYLD

SEQ ID NO: 2280 - protein, 11 aa, Artificial Sequence
  Made in Lab - CRDL1 from anti-Fzd VL chain
RASQSISRWLA

SEQ ID NO: 2281 - protein, 11 aa, Artificial Sequence
  Made in Lab - CRDL1 from anti-Fzd VL chain
RASQSISTYLN

SEQ ID NO: 2282 - protein, 11 aa, Artificial Sequence
  Made in Lab - CRDL1 from anti-Fzd VL chain
RASQNINSYLH

SEQ ID NO: 2283 - protein, 16 aa, Artificial Sequence
  Made in Lab - CRDL1 from anti-Fzd VL chain
RSSQSLLHSNGYNYLD

SEQ ID NO: 2284 - protein, 11 aa, Artificial Sequence
  Made in Lab - CRDL1 from anti-Fzd VL chain
RASQDISNYLN

SEQ ID NO: 2285 - protein, 11 aa, Artificial Sequence
  Made in Lab - CRDL1 from anti-Fzd VL chain
RASQDIRSDLG

SEQ ID NO: 2286 - protein, 11 aa, Artificial Sequence
  Made in Lab - CRDL1 from anti-Fzd VL chain
RASQYISNYLN

SEQ ID NO: 2287 - protein, 11 aa, Artificial Sequence
  Made in Lab - CRDL1 from anti-Fzd VL chain
RASQSISRWLA

SEQ ID NO: 2288 - protein, 17 aa, Artificial Sequence
  Made in Lab - CRDL1 from anti-Fzd VL chain
KSSQSVLYSSNNKNYLA

SEQ ID NO: 2289 - protein, 11 aa, Artificial Sequence
  Made in Lab - CRDL1 from anti-Fzd VL chain
QASQDISNYLN

SEQ ID NO: 2290 - protein, 11 aa, Artificial Sequence
  Made in Lab - CRDL1 from anti-Fzd VL chain
QASQDISNYLN

SEQ ID NO: 2291 - protein, 11 aa, Artificial Sequence
  Made in Lab - CRDL1 from anti-Fzd VL chain
RASQSINNWLA

SEQ ID NO: 2292 - protein, 11 aa, Artificial Sequence
  Made in Lab - CRDL1 from anti-Fzd VL chain
RASQSISSYLN

SEQ ID NO: 2293 - protein, 11 aa, Artificial Sequence
  Made in Lab - CRDL1 from anti-Fzd VL chain
RASQSIZSYLN

SEQ ID NO: 2294 - protein, 11 aa, Artificial Sequence
  Made in Lab - CRDL1 from anti-Fzd VL chain
RASQSISSYLN

SEQ ID NO: 2295 - protein, 17 aa, Artificial Sequence
  Made in Lab - CRDL1 from anti-Fzd VL chain
KSSRSVLNSSNNKNYLA

SEQ ID NO: 2296 - protein, 16 aa, Artificial Sequence
  Made in Lab - CRDL1 from anti-Fzd VL chain
RSSQSLLHSNGYNYLD

SEQ ID NO: 2297 - protein, 11 aa, Artificial Sequence
  Made in Lab - CRDL1 from anti-Fzd VL chain
RASQSISVYLN

SEQ ID NO: 2298 - protein, 11 aa, Artificial Sequence
  Made in Lab - CRDL1 from anti-Fzd VL chain
RASQSISSYLN

SEQ ID NO: 2299 - protein, 16 aa, Artificial Sequence
  Made in Lab - CRDL1 from anti-Fzd VL chain
RSSQSLLHSNGYNYLD

SEQ ID NO: 2300 - protein, 11 aa, Artificial Sequence
  Made in Lab - CRDL1 from anti-Fzd VL chain
RASQSINRYLN

SEQ ID NO: 2301 - protein, 11 aa, Artificial Sequence
  Made in Lab - CRDL1 from anti-Fzd VL chain
RASQSISRHLT

SEQ ID NO: 2302 - protein, 11 aa, Artificial Sequence
  Made in Lab - CRDL1 from anti-Fzd VL chain
RASQSISTYLN

SEQ ID NO: 2303 - protein, 11 aa, Artificial Sequence
  Made in Lab - CRDL1 from anti-Fzd VL chain
RASQGIGTWLA

SEQ ID NO: 2304 - protein, 11 aa, Artificial Sequence
  Made in Lab - CRDL1 from anti-Fzd VL chain
RASQSINKWLA

SEQ ID NO: 2305 - protein, 16 aa, Artificial Sequence
  Made in Lab - CRDL1 from anti-Fzd VL chain
RSSQSLLHSNGYNYLD

SEQ ID NO: 2306 - protein, 17 aa, Artificial Sequence
  Made in Lab - CRDL1 from anti-Fzd VL chain
KSSQSVLYSSNNKNYLA

SEQ ID NO: 2307 - protein, 17 aa, Artificial Sequence
  Made in Lab - CRDL1 from anti-Fzd VL chain
KSSQSVLYRSNNKNYLA

SEQ ID NO: 2308 - protein, 11 aa, Artificial Sequence
  Made in Lab - CRDL1 from anti-Fzd VL chain
QASQDISNYLN

SEQ ID NO: 2309 - protein, 11 aa, Artificial Sequence
  Made in Lab - CRDL1 from anti-Fzd VL chain
QASQDISNYLN

SEQ ID NO: 2310 - protein, 16 aa, Artificial Sequence
  Made in Lab - CRDL1 from anti-Fzd VL chain
RSSQSLLHSNGYNYLD

SEQ ID NO: 2311 - protein, 16 aa, Artificial Sequence
  Made in Lab - CRDL1 from anti-Fzd VL chain
RSSQSLLHSNGYNYLD

SEQ ID NO: 2312 - protein, 11 aa, Artificial Sequence
  Made in Lab - CRDL1 from anti-Fzd VL chain
QASQDITNYLN

SEQ ID NO: 2313 - protein, 16 aa, Artificial Sequence
  Made in Lab - CRDL1 from anti-Fzd VL chain
RSSQSLLHZZZYNYLD

SEQ ID NO: 2314 - protein, 11 aa, Artificial Sequence
  Made in Lab - CRDL1 from anti-Fzd VL chain
RASQNISNYLN

SEQ ID NO: 2315 - protein, 16 aa, Artificial Sequence
  Made in Lab - CRDL1 from anti-Fzd VL chain
RSSQSLLHSNGYNYLD

SEQ ID NO: 2316 - protein, 11 aa, Artificial Sequence
  Made in Lab - CRDL1 from anti-Fzd VL chain
RASQSVSRWLA

SEQ ID NO: 2317 - protein, 16 aa, Artificial Sequence
  Made in Lab - CRDL1 from anti-Fzd VL chain
RSSQSLLHSNGYNYLD

SEQ ID NO: 2318 - protein, 11 aa, Artificial Sequence
  Made in Lab - CRDL1 from anti-Fzd VL chain
RASQTIDNYLQ

SEQ ID NO: 2319 - protein, 12 aa, Artificial Sequence
  Made in Lab - CRDL1 from anti-Fzd VL chain
RASQSVSSSYLS

SEQ ID NO: 2320 - protein, 11 aa, Artificial Sequence
  Made in Lab - CRDL1 from anti-Fzd VL chain
RASQSISNWLA

SEQ ID NO: 2321 - protein, 11 aa, Artificial Sequence
  Made in Lab - CRDL1 from anti-Fzd VL chain
RASQSISSYLN

SEQ ID NO: 2322 - protein, 16 aa, Artificial Sequence
  Made in Lab - CRDL1 from anti-Fzd VL chain
RSSQSLLHSNGYNYLD

SEQ ID NO: 2323 - protein, 11 aa, Artificial Sequence
  Made in Lab - CRDL1 from anti-Fzd VL chain
RASQAIRNDLG

SEQ ID NO: 2324 - protein, 11 aa, Artificial Sequence
  Made in Lab - CRDL1 from anti-Fzd VL chain
RASQGISNYLA

SEQ ID NO: 2325 - protein, 11 aa, Artificial Sequence
  Made in Lab - CRDL1 from anti-Fzd VL chain
RVSQGISSYLN

SEQ ID NO: 2326 - protein, 11 aa, Artificial Sequence
  Made in Lab - CRDL1 from anti-Fzd VL chain
RASQSISSYLN

SEQ ID NO: 2327 - protein, 11 aa, Artificial Sequence
  Made in Lab - CRDL1 from anti-Fzd VL chain
RASQSISSYLN

SEQ ID NO: 2328 - protein, 16 aa, Artificial Sequence
  Made in Lab - CRDL1 from anti-Fzd VL chain
RSSQSLLHSNGYNYLD

SEQ ID NO: 2329 - protein, 11 aa, Artificial Sequence
  Made in Lab - CRDL1 from anti-Fzd VL chain
RASQSISTWLA

SEQ ID NO: 2330 - protein, 11 aa, Artificial Sequence
  Made in Lab - CRDL1 from anti-Fzd VL chain
RASQSVSSNLA

SEQ ID NO: 2331 - protein, 16 aa, Artificial Sequence
  Made in Lab - CRDL1 from anti-Fzd VL chain
RSSQSLZHSNGYNYLD

SEQ ID NO: 2332 - protein, 11 aa, Artificial Sequence
  Made in Lab - CRDL1 from anti-Fzd VL chain
RASZSIZSWLA

SEQ ID NO: 2333 - protein, 11 aa, Artificial Sequence
  Made in Lab - CRDL1 from anti-Fzd VL chain
RASQGIGNFLA

SEQ ID NO: 2334 - protein, 11 aa, Artificial Sequence
  Made in Lab - CRDL1 from anti-Fzd VL chain
RASQGISSWLA

SEQ ID NO: 2335 - protein, 16 aa, Artificial Sequence
  Made in Lab - CRDL1 from anti-Fzd VL chain
RSSQSLLHSNGYNYLD

SEQ ID NO: 2336 - protein, 16 aa, Artificial Sequence
  Made in Lab - CRDL1 from anti-Fzd VL chain
RSSRSLLYTNGLTYID

SEQ ID NO: 2337 - protein, 16 aa, Artificial Sequence
  Made in Lab - CRDL1 from anti-Fzd VL chain
RSSQSLLHSNGYNYLD

SEQ ID NO: 2338 - protein, 16 aa, Artificial Sequence
  Made in Lab - CRDL1 from anti-Fzd VL chain
RSIQSLLHSNGYKYLD

SEQ ID NO: 2339 - protein, 16 aa, Artificial Sequence
  Made in Lab - CRDL1 from anti-Fzd VL chain
RSSQSRASQNIZNYLA

SEQ ID NO: 2340 - protein, 11 aa, Artificial Sequence
  Made in Lab - CRDL1 from anti-Fzd VL chain
RASQSISTWLA

SEQ ID NO: 2341 - protein, 11 aa, Artificial Sequence
  Made in Lab - CRDL1 from anti-Fzd VL chain
RASQGISNYLA

SEQ ID NO: 2342 - protein, 11 aa, Artificial Sequence
  Made in Lab - CRDL1 from anti-Fzd VL chain
RASQDIGNELG

SEQ ID NO: 2343 - protein, 11 aa, Artificial Sequence
  Made in Lab - CRDL1 from anti-Fzd VL chain
QASQDISNYLN

SEQ ID NO: 2344 - protein, 11 aa, Artificial Sequence
  Made in Lab - CRDL1 from anti-Fzd VL chain
RASQGIGNFLA

SEQ ID NO: 2345 - protein, 11 aa, Artificial Sequence
  Made in Lab - CRDL1 from anti-Fzd VL chain
RASQDIRTNLA

SEQ ID NO: 2346 - protein, 11 aa, Artificial Sequence
  Made in Lab - CRDL1 from anti-Fzd VL chain
RASQNINTYLN

SEQ ID NO: 2347 - protein, 16 aa, Artificial Sequence
  Made in Lab - CRDL1 from anti-Fzd VL chain
RSSRSLLHKNGHTYVE

SEQ ID NO: 2348 - protein, 11 aa, Artificial Sequence
  Made in Lab - CRDL1 from anti-Fzd VL chain
RASQSISSRLA

SEQ ID NO: 2349 - protein, 11 aa, Artificial Sequence
  Made in Lab - CRDL1 from anti-Fzd VL chain
QASQDISNYLN

SEQ ID NO: 2350 - protein, 16 aa, Artificial Sequence
  Made in Lab - CRDL1 from anti-Fzd VL chain
RSSQSLLHSNGYNYLD

SEQ ID NO: 2351 - protein, 16 aa, Artificial Sequence
  Made in Lab - CRDL1 from anti-Fzd VL chain
RSSQSLLHSNGYNYLD

SEQ ID NO: 2352 - protein, 11 aa, Artificial Sequence
  Made in Lab - CRDL1 from anti-Fzd VL chain
RASQGINNYLA

SEQ ID NO: 2353 - protein, 9 aa, Artificial Sequence
  Made in Lab - CRDL1 from anti-Fzd VL chain
YTFSSYYMH

SEQ ID NO: 2354 - protein, 11 aa, Artificial Sequence
  Made in Lab - CRDL1 from anti-Fzd VL chain
RASQDIRNYLA

SEQ ID NO: 2355 - protein, 16 aa, Artificial Sequence
  Made in Lab - CRDL1 from anti-Fzd VL chain
RSSQSLLHSNGYNYLD

SEQ ID NO: 2356 - protein, 11 aa, Artificial Sequence
  Made in Lab - CRDL1 from anti-Fzd VL chain
RASZDIRNYLA

SEQ ID NO: 2357 - protein, 16 aa, Artificial Sequence
  Made in Lab - CRDL1 from anti-Fzd VL chain
RSSQSLLHSNGYNYLD

SEQ ID NO: 2358 - protein, 17 aa, Artificial Sequence
  Made in Lab - CRDL1 from anti-Fzd VL chain
KSSRSVLYSSNKKNYLA

SEQ ID NO: 2359 - protein, 11 aa, Artificial Sequence
  Made in Lab - CRDL1 from anti-Fzd VL chain
RASQGISSSLA

SEQ ID NO: 2360 - protein, 11 aa, Artificial Sequence
  Made in Lab - CRDL1 from anti-Fzd VL chain
RASQGISNNLN

SEQ ID NO: 2361 - protein, 16 aa, Artificial Sequence
  Made in Lab - CRDL1 from anti-Fzd VL chain
RSSQSLLHSNGYNYLD

SEQ ID NO: 2362 - protein, 11 aa, Artificial Sequence
  Made in Lab - CRDL1 from anti-Fzd VL chain
RASQSISTWLA

SEQ ID NO: 2363 - protein, 16 aa, Artificial Sequence
  Made in Lab - CRDL1 from anti-Fzd VL chain
RSSQSLLHSNGYNYLD

SEQ ID NO: 2364 - protein, 16 aa, Artificial Sequence
  Made in Lab - CRDL1 from anti-Fzd VL chain
RSSQSLLHSNGYNYLD

SEQ ID NO: 2365 - protein, 11 aa, Artificial Sequence
  Made in Lab - CRDL1 from anti-Fzd VL chain
RASQGISTWLS

SEQ ID NO: 2366 - protein, 16 aa, Artificial Sequence
  Made in Lab - CRDL1 from anti-Fzd VL chain
RSSQSLLHSNGYNYLD

SEQ ID NO: 2367 - protein, 11 aa, Artificial Sequence
  Made in Lab - CRDL1 from anti-Fzd VL chain
RASQSISSYLN

SEQ ID NO: 2368 - protein, 11 aa, Artificial Sequence
  Made in Lab - CRDL1 from anti-Fzd VL chain
QASQSISTHLN

SEQ ID NO: 2369 - protein, 11 aa, Artificial Sequence
  Made in Lab - CRDL1 from anti-Fzd VL chain
RASQSVGTWLA

SEQ ID NO: 2370 - protein, 16 aa, Artificial Sequence
  Made in Lab - CRDL1 from anti-Fzd VL chain
RSSQSLLHSNGYNYLD

SEQ ID NO: 2371 - protein, 11 aa, Artificial Sequence
  Made in Lab - CRDL1 from anti-Fzd VL chain
RSGRPIADYLS

SEQ ID NO: 2372 - protein, 16 aa, Artificial Sequence
  Made in Lab - CRDL1 from anti-Fzd VL chain
RSSQSLLHSNGYNYLD

SEQ ID NO: 2373 - protein, 16 aa, Artificial Sequence
  Made in Lab - CRDL1 from anti-Fzd VL chain
RSSQSLLHSNGYNYLD

SEQ ID NO: 2374 - protein, 16 aa, Artificial Sequence
  Made in Lab - CRDL1 from anti-Fzd VL chain
RSSQSLLHSNGYNYLD

SEQ ID NO: 2375 - protein, 11 aa, Artificial Sequence
  Made in Lab - CRDL1 from anti-Fzd VL chain
RZSQGIGNFLA

SEQ ID NO: 2376 - protein, 16 aa, Artificial Sequence
  Made in Lab - CRDL1 from anti-Fzd VL chain
RSSQSLLHSNGYNYLD

SEQ ID NO: 2377 - protein, 11 aa, Artificial Sequence
  Made in Lab - CRDL1 from anti-Fzd VL chain
RASQSISRWLA

SEQ ID NO: 2378 - protein, 16 aa, Artificial Sequence
  Made in Lab - CRDL1 from anti-Fzd VL chain
RSSQSLLHSNGYNYLD

SEQ ID NO: 2379 - protein, 16 aa, Artificial Sequence
  Made in Lab - CRDL1 from anti-Fzd VL chain
RSSQSLLHSNGYNYLD

SEQ ID NO: 2380 - protein, 16 aa, Artificial Sequence
  Made in Lab - CRDL1 from anti-Fzd VL chain
RSSQSLLHSNGYNYLD

SEQ ID NO: 2381 - protein, 16 aa, Artificial Sequence
  Made in Lab - CRDL1 from anti-Fzd VL chain
KSSQSLLHSDGKTYLY

SEQ ID NO: 2382 - protein, 16 aa, Artificial Sequence
  Made in Lab - CRDL1 from anti-Fzd VL chain
RSSQSLLHSNGYNYLD

SEQ ID NO: 2383 - protein, 16 aa, Artificial Sequence
  Made in Lab - CRDL1 from anti-Fzd VL chain
RSSQSLLHSNGYNYLD

SEQ ID NO: 2384 - protein, 17 aa, Artificial Sequence
  Made in Lab - CRDL1 from anti-Fzd VL chain
KSSRSVLYSSNKKNYLA

SEQ ID NO: 2385 - protein, 16 aa, Artificial Sequence
  Made in Lab - CRDL1 from anti-Fzd VL chain
RSSQSLLHSNGYNYLD

SEQ ID NO: 2386 - protein, 16 aa, Artificial Sequence
  Made in Lab - CRDL1 from anti-Fzd VL chain
RSSRSLLYSNGYNYLD

SEQ ID NO: 2387 - protein, 16 aa, Artificial Sequence
  Made in Lab - CRDL1 from anti-Fzd VL chain
RSSQSLLHSNGYNYLD

SEQ ID NO: 2388 - protein, 11 aa, Artificial Sequence
  Made in Lab - CRDL1 from anti-Fzd VL chain
RASQGIGNFLA

SEQ ID NO: 2389 - protein, 16 aa, Artificial Sequence
  Made in Lab - CRDL1 from anti-Fzd VL chain
RSSQSLLHSNGYNYLD

SEQ ID NO: 2390 - protein, 16 aa, Artificial Sequence
  Made in Lab - CRDL1 from anti-Fzd VL chain
RSSQSLLHSNGYNYLD

SEQ ID NO: 2391 - protein, 16 aa, Artificial Sequence
  Made in Lab - CRDL1 from anti-Fzd VL chain
RSSQSLLHSNGYNYLD

SEQ ID NO: 2392 - protein, 16 aa, Artificial Sequence
  Made in Lab - CRDL1 from anti-Fzd VL chain
RSSQSLLHSNGYNYLD

SEQ ID NO: 2393 - protein, 11 aa, Artificial Sequence
  Made in Lab - CRDL1 from anti-Fzd VL chain
RASQGIRNDLG

SEQ ID NO: 2394 - protein, 16 aa, Artificial Sequence
  Made in Lab - CRDL1 from anti-Fzd VL chain
RSSRSLLYSNGYNYLD

SEQ ID NO: 2395 - protein, 14 aa, Artificial Sequence
  Made in Lab - CRDL1 from anti-Fzd VL chain
TLHSGINVGTYRIY

SEQ ID NO: 2396 - protein, 11 aa, Artificial Sequence
  Made in Lab - CRDL1 from anti-Fzd VL chain
RASQSISSYLN

SEQ ID NO: 2397 - protein, 17 aa, Artificial Sequence
  Made in Lab - CRDL1 from anti-Fzd VL chain
KSSQSLLYSSNNKNYLA

SEQ ID NO: 2398 - protein, 11 aa, Artificial Sequence
  Made in Lab - CRDL1 from anti-Fzd VL chain
RASETISSWLA

SEQ ID NO: 2399 - protein, 16 aa, Artificial Sequence
  Made in Lab - CRDL1 from anti-Fzd VL chain
RSSQSLLHSNGYNYLD

SEQ ID NO: 2400 - protein, 16 aa, Artificial Sequence
  Made in Lab - CRDL1 from anti-Fzd VL chain
RSSQSLLHSNGYNYLD

SEQ ID NO: 2401 - protein, 16 aa, Artificial Sequence
  Made in Lab - CRDL1 from anti-Fzd VL chain
RZSQSLLHSZGYNYLD

SEQ ID NO: 2402 - protein, 16 aa, Artificial Sequence
  Made in Lab - CRDL1 from anti-Fzd VL chain
RSSQSLLHSNGYNYLD

SEQ ID NO: 2403 - protein, 16 aa, Artificial Sequence
  Made in Lab - CRDL1 from anti-Fzd VL chain
RSSQSLLHSNGYNYLD

SEQ ID NO: 2404 - protein, 16 aa, Artificial Sequence
  Made in Lab - CRDL1 from anti-Fzd VL chain
RSSQSLLHSNGYNYLD

SEQ ID NO: 2405 - protein, 16 aa, Artificial Sequence
  Made in Lab - CRDL1 from anti-Fzd VL chain
RSSQSLLHSNGYNYLD

SEQ ID NO: 2406 - protein, 16 aa, Artificial Sequence
  Made in Lab - CRDL1 from anti-Fzd VL chain
RSSQSLLHSNGYNYLD

SEQ ID NO: 2407 - protein, 11 aa, Artificial Sequence
  Made in Lab - CRDL1 from anti-Fzd VL chain
RASQSISSSLN

SEQ ID NO: 2408 - protein, 11 aa, Artificial Sequence
  Made in Lab - CRDL1 from anti-Fzd VL chain
RASETISSWLA

SEQ ID NO: 2409 - protein, 16 aa, Artificial Sequence
  Made in Lab - CRDL1 from anti-Fzd VL chain
RSSQSLLHSNGYNYLD

SEQ ID NO: 2410 - protein, 11 aa, Artificial Sequence
  Made in Lab - CRDL1 from anti-Fzd VL chain
RASQNIGPWLA

SEQ ID NO: 2411 - protein, 16 aa, Artificial Sequence
  Made in Lab - CRDL1 from anti-Fzd VL chain
RSSQSLLHSNGYNYLD

SEQ ID NO: 2412 - protein, 16 aa, Artificial Sequence
  Made in Lab - CRDL1 from anti-Fzd VL chain
RSSQSLLHSNGYNYLD

SEQ ID NO: 2413 - protein, 16 aa, Artificial Sequence
  Made in Lab - CRDL1 from anti-Fzd VL chain
RCSQSLLPSNGYNYLD

SEQ ID NO: 2414 - protein, 11 aa, Artificial Sequence
  Made in Lab - CRDL1 from anti-Fzd VL chain
RASQDISNWLA

SEQ ID NO: 2415 - protein, 11 aa, Artificial Sequence
  Made in Lab - CRDL1 from anti-Fzd VL chain
RASQGINNYLN

SEQ ID NO: 2416 - protein, 11 aa, Artificial Sequence
  Made in Lab - CRDL1 from anti-Fzd VL chain
RASQGIAGWLA

SEQ ID NO: 2417 - protein, 11 aa, Artificial Sequence
  Made in Lab - CRDL1 from anti-Fzd VL chain
RASQSINRWLA

SEQ ID NO: 2418 - protein, 16 aa, Artificial Sequence
  Made in Lab - CRDL1 from anti-Fzd VL chain
RSSQSLLHSNGYNYLD

SEQ ID NO: 2419 - protein, 11 aa, Artificial Sequence
  Made in Lab - CRDL1 from anti-Fzd VL chain
RASQTISNFLN

SEQ ID NO: 2420 - protein, 11 aa, Artificial Sequence
  Made in Lab - CRDL1 from anti-Fzd VL chain
RASQGISNYLN

SEQ ID NO: 2421 - protein, 11 aa, Artificial Sequence
  Made in Lab - CRDL1 from anti-Fzd VL chain
RASQSISSYLN

SEQ ID NO: 2422 - protein, 17 aa, Artificial Sequence
  Made in Lab - CRDL1 from anti-Fzd VL chain
KSSQSVLYSSNNKNYLA

SEQ ID NO: 2423 - protein, 11 aa, Artificial Sequence
  Made in Lab - CRDL1 from anti-Fzd VL chain
RASQSIHSWLA

SEQ ID NO: 2424 - protein, 11 aa, Artificial Sequence
  Made in Lab - CRDL1 from anti-Fzd VL chain
RASQSISSYLN

SEQ ID NO: 2425 - protein, 11 aa, Artificial Sequence
  Made in Lab - CRDL1 from anti-Fzd VL chain
RASQSISSYLN

SEQ ID NO: 2426 - protein, 17 aa, Artificial Sequence
  Made in Lab - CRDL1 from anti-Fzd VL chain
KSSQSVLYSSNNKNYLA

SEQ ID NO: 2427 - protein, 12 aa, Artificial Sequence
  Made in Lab - CRDL1 from anti-Fzd VL chain
RASQSVSNNYLA

SEQ ID NO: 2428 - protein, 11 aa, Artificial Sequence
  Made in Lab - CRDL1 from anti-Fzd VL chain
RASQSVSSNLA

SEQ ID NO: 2429 - protein, 11 aa, Artificial Sequence
  Made in Lab - CRDL1 from anti-Fzd VL chain
RASQGISNNLN

SEQ ID NO: 2430 - protein, 11 aa, Artificial Sequence
  Made in Lab - CRDL1 from anti-Fzd VL chain
QASRDISNYLN

SEQ ID NO: 2431 - protein, 16 aa, Artificial Sequence
  Made in Lab - CRDL1 from anti-Fzd VL chain
RSSQSLLHSNGYNYLD

SEQ ID NO: 2432 - protein, 17 aa, Artificial Sequence
  Made in Lab - CRDL1 from anti-Fzd VL chain
KSSQSVLYSSNNKNYLA

SEQ ID NO: 2433 - protein, 11 aa, Artificial Sequence
  Made in Lab - CRDL1 from anti-Fzd VL chain
RASQSISSWLA

SEQ ID NO: 2434 - protein, 16 aa, Artificial Sequence
  Made in Lab - CRDL1 from anti-Fzd VL chain
RSSQSLLHSNGYNYLD

SEQ ID NO: 2435 - protein, 11 aa, Artificial Sequence
  Made in Lab - CRDL1 from anti-Fzd VL chain
RASQAISSYLA

SEQ ID NO: 2436 - protein, 11 aa, Artificial Sequence
  Made in Lab - CRDL1 from anti-Fzd VL chain
RASQSISSYLN

SEQ ID NO: 2437 - protein, 11 aa, Artificial Sequence
  Made in Lab - CRDL1 from anti-Fzd VL chain
RASQSVSSYLA

SEQ ID NO: 2438 - protein, 11 aa, Artificial Sequence
  Made in Lab - CRDL1 from anti-Fzd VL chain
RASQSISSYLD

SEQ ID NO: 2439 - protein, 11 aa, Artificial Sequence
  Made in Lab - CRDL1 from anti-Fzd VL chain
RASQGISNYLA

SEQ ID NO: 2440 - protein, 11 aa, Artificial Sequence
  Made in Lab - CRDL1 from anti-Fzd VL chain
RASQSISSYLN

SEQ ID NO: 2441 - protein, 17 aa, Artificial Sequence
  Made in Lab - CRDL1 from anti-Fzd VL chain
RSSRSLVYNANNKSYLA

SEQ ID NO: 2442 - protein, 11 aa, Artificial Sequence
  Made in Lab - CRDL1 from anti-Fzd VL chain
RASESIGSYLN

SEQ ID NO: 2443 - protein, 11 aa, Artificial Sequence
  Made in Lab - CRDL1 from anti-Fzd VL chain
RASQSISNWLA

SEQ ID NO: 2444 - protein, 11 aa, Artificial Sequence
  Made in Lab - CRDL1 from anti-Fzd VL chain
QASQGISNYLA

SEQ ID NO: 2445 - protein, 11 aa, Artificial Sequence
  Made in Lab - CRDL1 from anti-Fzd VL chain
QASQSIYNYLN

SEQ ID NO: 2446 - protein, 11 aa, Artificial Sequence
  Made in Lab - CRDL1 from anti-Fzd VL chain
QASQDISNYLN

SEQ ID NO: 2447 - protein, 17 aa, Artificial Sequence
  Made in Lab - CRDL1 from anti-Fzd VL chain
RSSQSVLSSSTYKNYLA

SEQ ID NO: 2448 - protein, 11 aa, Artificial Sequence
  Made in Lab - CRDL1 from anti-Fzd VL chain
RASRSIGPWLA

SEQ ID NO: 2449 - protein, 16 aa, Artificial Sequence
  Made in Lab - CRDL1 from anti-Fzd VL chain
RSSQSLLHSNGYNYLD

SEQ ID NO: 2450 - protein, 11 aa, Artificial Sequence
  Made in Lab - CRDL1 from anti-Fzd VL chain
RASQSVSTWLA

SEQ ID NO: 2451 - protein, 11 aa, Artificial Sequence
  Made in Lab - CRDL1 from anti-Fzd VL chain
RVSQDISNSLN

SEQ ID NO: 2452 - protein, 17 aa, Artificial Sequence
  Made in Lab - CRDL1 from anti-Fzd VL chain
KSSQSVLYSSNNKNYLA

SEQ ID NO: 2453 - protein, 11 aa, Artificial Sequence
  Made in Lab - CRDL1 from anti-Fzd VL chain
RASQGISNYLA

SEQ ID NO: 2454 - protein, 12 aa, Artificial Sequence
  Made in Lab - CRDL1 from anti-Fzd VL chain
RASQSISSSYLA

SEQ ID NO: 2455 - protein, 16 aa, Artificial Sequence
  Made in Lab - CRDL1 from anti-Fzd VL chain
RSSQSLLHSNGYNYLD

SEQ ID NO: 2456 - protein, 11 aa, Artificial Sequence
  Made in Lab - CRDL1 from anti-Fzd VL chain
RASQSISSYLN

SEQ ID NO: 2457 - protein, 16 aa, Artificial Sequence
  Made in Lab - CRDL1 from anti-Fzd VL chain
RSSQSLLHSNGYNYLD

SEQ ID NO: 2458 - protein, 11 aa, Artificial Sequence
  Made in Lab - CRDL1 from anti-Fzd VL chain
QASQDISNYLN

SEQ ID NO: 2459 - protein, 11 aa, Artificial Sequence
  Made in Lab - CRDL1 from anti-Fzd VL chain
RASQSISTYLN

SEQ ID NO: 2460 - protein, 11 aa, Artificial Sequence
  Made in Lab - CRDL1 from anti-Fzd VL chain
RASQSINRWLA

SEQ ID NO: 2461 - protein, 11 aa, Artificial Sequence
  Made in Lab - CRDL1 from anti-Fzd VL chain
QASQDISNYLN

SEQ ID NO: 2462 - protein, 11 aa, Artificial Sequence
  Made in Lab - CRDL1 from anti-Fzd VL chain
RASQSISSYLN

SEQ ID NO: 2463 - protein, 17 aa, Artificial Sequence
  Made in Lab - CRDL1 from anti-Fzd VL chain
KSSQSVLYSSNNKNYLA

SEQ ID NO: 2464 - protein, 16 aa, Artificial Sequence
  Made in Lab - CRDL1 from anti-Fzd VL chain
RSSQSLLHSNGYNYLD

SEQ ID NO: 2465 - protein, 11 aa, Artificial Sequence
  Made in Lab - CRDL1 from anti-Fzd VL chain
RASQGISNYLA

SEQ ID NO: 2466 - protein, 11 aa, Artificial Sequence
  Made in Lab - CRDL1 from anti-Fzd VL chain
QASQDISNYLN

SEQ ID NO: 2467 - protein, 16 aa, Artificial Sequence
  Made in Lab - CRDL1 from anti-Fzd VL chain
RSSQSLLHSNGYNYLD

SEQ ID NO: 2468 - protein, 11 aa, Artificial Sequence
  Made in Lab - CRDL1 from anti-Fzd VL chain
RASQNVNRWLA

SEQ ID NO: 2469 - protein, 11 aa, Artificial Sequence
  Made in Lab - CRDL1 from anti-Fzd VL chain
RASQSISSYLN

SEQ ID NO: 2470 - protein, 16 aa, Artificial Sequence
  Made in Lab - CRDL1 from anti-Fzd VL chain
RSSQSLLHSNGYNYLD

SEQ ID NO: 2471 - protein, 11 aa, Artificial Sequence
  Made in Lab - CRDL1 from anti-Fzd VL chain
RASQGISNYLA

SEQ ID NO: 2472 - protein, 11 aa, Artificial Sequence
  Made in Lab - CRDL1 from anti-Fzd VL chain
RASQGISNYLA

SEQ ID NO: 2473 - protein, 11 aa, Artificial Sequence
  Made in Lab - CRDL1 from anti-Fzd VL chain
RASQGISSYLA

SEQ ID NO: 2474 - protein, 11 aa, Artificial Sequence
  Made in Lab - CRDL1 from anti-Fzd VL chain
RASQGINNYLA

SEQ ID NO: 2475 - protein, 11 aa, Artificial Sequence
  Made in Lab - CRDL1 from anti-Fzd VL chain
RASQTTKNYLN

SEQ ID NO: 2476 - protein, 11 aa, Artificial Sequence
  Made in Lab - CRDL1 from anti-Fzd VL chain
RAGQSIGSFLN

SEQ ID NO: 2477 - protein, 11 aa, Artificial Sequence
  Made in Lab - CRDL1 from anti-Fzd VL chain
RASQAIRNDLA

SEQ ID NO: 2478 - protein, 11 aa, Artificial Sequence
  Made in Lab - CRDL1 from anti-Fzd VL chain
RASQGISNYLA

SEQ ID NO: 2479 - protein, 11 aa, Artificial Sequence
  Made in Lab - CRDL1 from anti-Fzd VL chain
RASQSISSYLN

SEQ ID NO: 2480 - protein, 16 aa, Artificial Sequence
  Made in Lab - CRDL1 from anti-Fzd VL chain
RSSQSLLHSNGYNYLD

SEQ ID NO: 2481 - protein, 12 aa, Artificial Sequence
  Made in Lab - CRDL1 from anti-Fzd VL chain
RASQSVSSNYLA

SEQ ID NO: 2482 - protein, 12 aa, Artificial Sequence
  Made in Lab - CRDL1 from anti-Fzd VL chain
RASQSVASSYLA

SEQ ID NO: 2483 - protein, 11 aa, Artificial Sequence
  Made in Lab - CRDL1 from anti-Fzd VL chain
RASQSVSSYLA

SEQ ID NO: 2484 - protein, 12 aa, Artificial Sequence
  Made in Lab - CRDL1 from anti-Fzd VL chain
RASQSVSSSYLA

SEQ ID NO: 2485 - protein, 11 aa, Artificial Sequence
  Made in Lab - CRDL1 from anti-Fzd VL chain
RASQSISSWLA

SEQ ID NO: 2486 - protein, 11 aa, Artificial Sequence
  Made in Lab - CRDL1 from anti-Fzd VL chain
RASQSISRYLN

SEQ ID NO: 2487 - protein, 11 aa, Artificial Sequence
  Made in Lab - CRDL1 from anti-Fzd VL chain
RASQGISNYLA

SEQ ID NO: 2488 - protein, 16 aa, Artificial Sequence
  Made in Lab - CRDL1 from anti-Fzd VL chain
RSSQSLLHSNGYNYLD

SEQ ID NO: 2489 - protein, 16 aa, Artificial Sequence
  Made in Lab - CRDL1 from anti-Fzd VL chain
RSSQSLLHSNGYNYLD

SEQ ID NO: 2490 - protein, 16 aa, Artificial Sequence
  Made in Lab - CRDL1 from anti-Fzd VL chain
RSSQSLLHSNGYNYLD

SEQ ID NO: 2491 - protein, 16 aa, Artificial Sequence
  Made in Lab - CRDL1 from anti-Fzd VL chain
RSSQSLLHSNGYNYLD

SEQ ID NO: 2492 - protein, 11 aa, Artificial Sequence
  Made in Lab - CRDL1 from anti-Fzd VL chain
RASQGISNYLA

SEQ ID NO: 2493 - protein, 11 aa, Artificial Sequence
  Made in Lab - CRDL1 from anti-Fzd VL chain
QASQDISNYLN

SEQ ID NO: 2494 - protein, 16 aa, Artificial Sequence
  Made in Lab - CRDL1 from anti-Fzd VL chain
RSSQSLLHSNGYNYLD

SEQ ID NO: 2495 - protein, 11 aa, Artificial Sequence
  Made in Lab - CRDL1 from anti-Fzd VL chain
RASQSISSYLN

SEQ ID NO: 2496 - protein, 11 aa, Artificial Sequence
  Made in Lab - CRDL1 from anti-Fzd VL chain
RASQGIRNDLG

SEQ ID NO: 2497 - protein, 11 aa, Artificial Sequence
  Made in Lab - CRDL1 from anti-Fzd VL chain
QASQDISDYLN

SEQ ID NO: 2498 - protein, 16 aa, Artificial Sequence
  Made in Lab - CRDL1 from anti-Fzd VL chain
RSSQSLLHSNGYNYLD

SEQ ID NO: 2499 - protein, 16 aa, Artificial Sequence
  Made in Lab - CRDL1 from anti-Fzd VL chain
RSSQSLLHSNGYNYLD

SEQ ID NO: 2500 - protein, 11 aa, Artificial Sequence
  Made in Lab - CRDL1 from anti-Fzd VL chain
QASQDISNYLA

SEQ ID NO: 2501 - protein, 16 aa, Artificial Sequence
  Made in Lab - CRDL1 from anti-Fzd VL chain
RSSQSLLHSNGYNYLD

SEQ ID NO: 2502 - protein, 12 aa, Artificial Sequence
  Made in Lab - CRDL1 from anti-Fzd VL chain
RASQSVSSSYLA

SEQ ID NO: 2503 - protein, 11 aa, Artificial Sequence
  Made in Lab - CRDL1 from anti-Fzd VL chain
RASQSINTYLN

SEQ ID NO: 2504 - protein, 11 aa, Artificial Sequence
  Made in Lab - CRDL1 from anti-Fzd VL chain
RASQGIKNYLA

SEQ ID NO: 2505 - protein, 17 aa, Artificial Sequence
  Made in Lab - CRDL1 from anti-Fzd VL chain
KSSQSVLYRSNNKNYLA

SEQ ID NO: 2506 - protein, 11 aa, Artificial Sequence
  Made in Lab - CRDL1 from anti-Fzd VL chain
RASQDISNYLN

SEQ ID NO: 2507 - protein, 16 aa, Artificial Sequence
  Made in Lab - CRDL1 from anti-Fzd VL chain
RSSRSLLHSNGYNYLD

SEQ ID NO: 2508 - protein, 11 aa, Artificial Sequence
  Made in Lab - CRDL1 from anti-Fzd VL chain
RASQSISSYLN

SEQ ID NO: 2509 - protein, 11 aa, Artificial Sequence
  Made in Lab - CRDL1 from anti-Fzd VL chain
QASQDISNYLN

SEQ ID NO: 2510 - protein, 11 aa, Artificial Sequence
  Made in Lab - CRDL1 from anti-Fzd VL chain
QASQDIRNHLN

SEQ ID NO: 2511 - protein, 11 aa, Artificial Sequence
  Made in Lab - CRDL1 from anti-Fzd VL chain
RASQSIANHLN

SEQ ID NO: 2512 - protein, 11 aa, Artificial Sequence
  Made in Lab - CRDL1 from anti-Fzd VL chain
RASQSIANHLN

SEQ ID NO: 2513 - protein, 11 aa, Artificial Sequence
  Made in Lab - CRDL1 from anti-Fzd VL chain
RASQGISSWLS

SEQ ID NO: 2514 - protein, 11 aa, Artificial Sequence
  Made in Lab - CRDL1 from anti-Fzd VL chain
RASQSIANHLN

SEQ ID NO: 2515 - protein, 11 aa, Artificial Sequence
  Made in Lab - CRDL1 from anti-Fzd VL chain
RASQSVGTYLA

SEQ ID NO: 2516 - protein, 11 aa, Artificial Sequence
  Made in Lab - CRDL1 from anti-Fzd VL chain
RASQSISNWLA

SEQ ID NO: 2517 - protein, 11 aa, Artificial Sequence
  Made in Lab - CRDL1 from anti-Fzd VL chain
RASQSISSYLN

SEQ ID NO: 2518 - protein, 11 aa, Artificial Sequence
  Made in Lab - CRDL1 from anti-Fzd VL chain
RASQSVSSYLA

SEQ ID NO: 2519 - protein, 12 aa, Artificial Sequence
  Made in Lab - CRDL1 from anti-Fzd VL chain
RATQSVSSDYLA

SEQ ID NO: 2520 - protein, 13 aa, Artificial Sequence
  Made in Lab - CRDL1 from anti-Fzd VL chain
TRSSGSIAZYYVQ

SEQ ID NO: 2521 - protein, 16 aa, Artificial Sequence
  Made in Lab - CRDL1 from anti-Fzd VL chain
RSSQSLLHSNGYNYLD

SEQ ID NO: 2522 - protein, 13 aa, Artificial Sequence
  Made in Lab - CRDL1 from anti-Fzd VL chain
SGSKPNIGGHYVY

SEQ ID NO: 2523 - protein, 13 aa, Artificial Sequence
  Made in Lab - CRDL1 from anti-Fzd VL chain
TRSSGSIASYYVQ

SEQ ID NO: 2524 - protein, 16 aa, Artificial Sequence
  Made in Lab - CRDL1 from anti-Fzd VL chain
RSSKSLVYGDGNTYLN

SEQ ID NO: 2525 - protein, 13 aa, Artificial Sequence
  Made in Lab - CRDL1 from anti-Fzd VL chain
TRSSGSIGDKYVQ

SEQ ID NO: 2526 - protein, 13 aa, Artificial Sequence
  Made in Lab - CRDL1 from anti-Fzd VL chain
TGNSNNVGNRGAV

SEQ ID NO: 2527 - protein, 13 aa, Artificial Sequence
  Made in Lab - CRDL1 from anti-Fzd VL chain
TRSSGSIGDKYVQ

SEQ ID NO: 2528 - protein, 11 aa, Artificial Sequence
  Made in Lab - CRDL1 from anti-Fzd VL chain
SGDKLGDKFAY

SEQ ID NO: 2529 - protein, 16 aa, Artificial Sequence
  Made in Lab - CRDL1 from anti-Fzd VL chain
RSSQSVZYSDVNCYLN

SEQ ID NO: 2530 - protein, 13 aa, Artificial Sequence
  Made in Lab - CRDL1 from anti-Fzd VL chain
TGNSNNVGNRGAA

SEQ ID NO: 2531 - protein, 13 aa, Artificial Sequence
  Made in Lab - CRDL1 from anti-Fzd VL chain
TGNSNNVGNRGAV

SEQ ID NO: 2532 - protein, 13 aa, Artificial Sequence
  Made in Lab - CRDL1 from anti-Fzd VL chain
TRSSGSIGDKYVQ

SEQ ID NO: 2533 - protein, 13 aa, Artificial Sequence
  Made in Lab - CRDL1 from anti-Fzd VL chain
TRNSGNIATAYVQ

SEQ ID NO: 2534 - protein, 13 aa, Artificial Sequence
  Made in Lab - CRDL1 from anti-Fzd VL chain
SGSSSNIGSNAVN

SEQ ID NO: 2535 - protein, 13 aa, Artificial Sequence
  Made in Lab - CRDL1 from anti-Fzd VL chain
TRSSGSIGDKYVQ

SEQ ID NO: 2536 - protein, 13 aa, Artificial Sequence
  Made in Lab - CRDL1 from anti-Fzd VL chain
TRSSGSIGDKYVQ

SEQ ID NO: 2537 - protein, 13 aa, Artificial Sequence
  Made in Lab - CRDL1 from anti-Fzd VL chain
TGNSNNVGNRGAV

SEQ ID NO: 2538 - protein, 13 aa, Artificial Sequence
  Made in Lab - CRDL1 from anti-Fzd VL chain
TRSSGSIGDKYVQ

SEQ ID NO: 2539 - protein, 13 aa, Artificial Sequence
  Made in Lab - CRDL1 from anti-Fzd VL chain
TGNNYNVGNAGAA

SEQ ID NO: 2540 - protein, 13 aa, Artificial Sequence
  Made in Lab - CRDL1 from anti-Fzd VL chain
TRNSGNIATAYVQ

SEQ ID NO: 2541 - protein, 16 aa, Artificial Sequence
  Made in Lab - CRDL1 from anti-Fzd VL chain
RSSQSLLHSNGYNYLD

SEQ ID NO: 2542 - protein, 13 aa, Artificial Sequence
  Made in Lab - CRDL1 from anti-Fzd VL chain
TGNSNNVGNAGAV

SEQ ID NO: 2543 - protein, 13 aa, Artificial Sequence
  Made in Lab - CRDL1 from anti-Fzd VL chain
TRSSGSIGDKYVQ

SEQ ID NO: 2544 - protein, 13 aa, Artificial Sequence
  Made in Lab - CRDL1 from anti-Fzd VL chain
TGNSNNVGNRGAV

SEQ ID NO: 2545 - protein, 16 aa, Artificial Sequence
  Made in Lab - CRDL1 from anti-Fzd VL chain
RSSKSLVYZDGNTYLN

SEQ ID NO: 2546 - protein, 14 aa, Artificial Sequence
  Made in Lab - CRDL1 from anti-Fzd VL chain
TGTISDVGGYNYVS

SEQ ID NO: 2547 - protein, 13 aa, Artificial Sequence
  Made in Lab - CRDL1 from anti-Fzd VL chain
SGNSNNVGYAGAA

SEQ ID NO: 2548 - protein, 13 aa, Artificial Sequence
  Made in Lab - CRDL1 from anti-Fzd VL chain
SGNSNNVGYGGAV

SEQ ID NO: 2549 - protein, 16 aa, Artificial Sequence
  Made in Lab - CRDL1 from anti-Fzd VL chain
RSSQSLLHSNGYNYLD

SEQ ID NO: 2550 - protein, 13 aa, Artificial Sequence
  Made in Lab - CRDL1 from anti-Fzd VL chain
SGNSNNVGYGGAV

SEQ ID NO: 2551 - protein, 16 aa, Artificial Sequence
  Made in Lab - CRDL1 from anti-Fzd VL chain
RSSQSLLHSNGYNYLD

SEQ ID NO: 2552 - protein, 13 aa, Artificial Sequence
  Made in Lab - CRDL1 from anti-Fzd VL chain
TGNNYNVGNAGAA

SEQ ID NO: 2553 - protein, 13 aa, Artificial Sequence
  Made in Lab - CRDL1 from anti-Fzd VL chain
TGNNYNVGNAGAA

SEQ ID NO: 2554 - protein, 13 aa, Artificial Sequence
  Made in Lab - CRDL1 from anti-Fzd VL chain
TGNSNNVGNRGAV

SEQ ID NO: 2555 - protein, 13 aa, Artificial Sequence
  Made in Lab - CRDL1 from anti-Fzd VL chain
SGKNYZVGNAGAA

SEQ ID NO: 2556 - protein, 16 aa, Artificial Sequence
  Made in Lab - CRDL1 from anti-Fzd VL chain
RSSKSLVYSDGNTYLN

SEQ ID NO: 2557 - protein, 13 aa, Artificial Sequence
  Made in Lab - CRDL1 from anti-Fzd VL chain
TGNNYNVGNAGAA

SEQ ID NO: 2558 - protein, 13 aa, Artificial Sequence
  Made in Lab - CRDL1 from anti-Fzd VL chain
SGNNNNVGFAGAA

SEQ ID NO: 2559 - protein, 16 aa, Artificial Sequence
  Made in Lab - CRDL1 from anti-Fzd VL chain
KSSKSLVYGDGNTYLN

SEQ ID NO: 2560 - protein, 13 aa, Artificial Sequence
  Made in Lab - CRDL1 from anti-Fzd VL chain
SGNSNNVGYGGAV

SEQ ID NO: 2561 - protein, 13 aa, Artificial Sequence
  Made in Lab - CRDL1 from anti-Fzd VL chain
SGSSSNIGNNHVS

SEQ ID NO: 2562 - protein, 13 aa, Artificial Sequence
  Made in Lab - CRDL1 from anti-Fzd VL chain
TGNSNNVGNRGAV

SEQ ID NO: 2563 - protein, 13 aa, Artificial Sequence
  Made in Lab - CRDL1 from anti-Fzd VL chain
TGNSNNVGNRGAV

SEQ ID NO: 2564 - protein, 13 aa, Artificial Sequence
  Made in Lab - CRDL1 from anti-Fzd VL chain
TGSSNNVGNAGAA

SEQ ID NO: 2565 - protein, 13 aa, Artificial Sequence
  Made in Lab - CRDL1 from anti-Fzd VL chain
TRSGGGIASSFVQ

SEQ ID NO: 2566 - protein, 13 aa, Artificial Sequence
  Made in Lab - CRDL1 from anti-Fzd VL chain
SGSTSNIGYSFVS

SEQ ID NO: 2567 - protein, 13 aa, Artificial Sequence
  Made in Lab - CRDL1 from anti-Fzd VL chain
TGNNYNVGNAGAA

SEQ ID NO: 2568 - protein, 13 aa, Artificial Sequence
  Made in Lab - CRDL1 from anti-Fzd VL chain
SGSSSNIGNNYVS

SEQ ID NO: 2569 - protein, 13 aa, Artificial Sequence
  Made in Lab - CRDL1 from anti-Fzd VL chain
TGNNYNVGNAGAA

SEQ ID NO: 2570 - protein, 14 aa, Artificial Sequence
  Made in Lab - CRDL1 from anti-Fzd VL chain
TGTSSDVGGYNYVS

SEQ ID NO: 2571 - protein, 16 aa, Artificial Sequence
  Made in Lab - CRDL1 from anti-Fzd VL chain
RSSQSLLHSNGYNYLD

SEQ ID NO: 2572 - protein, 13 aa, Artificial Sequence
  Made in Lab - CRDL1 from anti-Fzd VL chain
TGNSNNVGKGGAA

SEQ ID NO: 2573 - protein, 13 aa, Artificial Sequence
  Made in Lab - CRDL1 from anti-Fzd VL chain
TGNNYNVGNAGAA

SEQ ID NO: 2574 - protein, 13 aa, Artificial Sequence
  Made in Lab - CRDL1 from anti-Fzd VL chain
TRSSGSIASNYVQ

SEQ ID NO: 2575 - protein, 13 aa, Artificial Sequence
  Made in Lab - CRDL1 from anti-Fzd VL chain
TGNSNNVGNRGAV

SEQ ID NO: 2576 - protein, 16 aa, Artificial Sequence
  Made in Lab - CRDL1 from anti-Fzd VL chain
KSSQSLLYFNGNTYLS

SEQ ID NO: 2577 - protein, 13 aa, Artificial Sequence
  Made in Lab - CRDL1 from anti-Fzd VL chain
TRSSGSIASNYVR

SEQ ID NO: 2578 - protein, 13 aa, Artificial Sequence
  Made in Lab - CRDL1 from anti-Fzd VL chain
TGNNYNVGNAGAA

SEQ ID NO: 2579 - protein, 16 aa, Artificial Sequence
  Made in Lab - CRDL1 from anti-Fzd VL chain
RSSQSLVYSDGDTYLN

SEQ ID NO: 2580 - protein, 14 aa, Artificial Sequence
  Made in Lab - CRDL1 from anti-Fzd VL chain
TGSSSNIGAGYDVH

SEQ ID NO: 2581 - protein, 14 aa, Artificial Sequence
  Made in Lab - CRDL1 from anti-Fzd VL chain
TGSSSNIGAGYDVH

SEQ ID NO: 2582 - protein, 16 aa, Artificial Sequence
  Made in Lab - CRDL1 from anti-Fzd VL chain
RSSQSLVHSDGNTYLN

SEQ ID NO: 2583 - protein, 13 aa, Artificial Sequence
  Made in Lab - CRDL1 from anti-Fzd VL chain
TRSSGSIGDKYVQ

SEQ ID NO: 2584 - protein, 13 aa, Artificial Sequence
  Made in Lab - CRDL1 from anti-Fzd VL chain
TGNSNNVGNRGAV

SEQ ID NO: 2585 - protein, 13 aa, Artificial Sequence
  Made in Lab - CRDL1 from anti-Fzd VL chain
TGNSNNVGNRGAV

SEQ ID NO: 2586 - protein, 13 aa, Artificial Sequence
  Made in Lab - CRDL1 from anti-Fzd VL chain
TGNNYNVGNAGAA

SEQ ID NO: 2587 - protein, 13 aa, Artificial Sequence
  Made in Lab - CRDL1 from anti-Fzd VL chain
TGNSNNVGKGGAA

SEQ ID NO: 2588 - protein, 16 aa, Artificial Sequence
  Made in Lab - CRDL1 from anti-Fzd VL chain
RSSQSLVYSDGNTYLN

SEQ ID NO: 2589 - protein, 16 aa, Artificial Sequence
  Made in Lab - CRDL1 from anti-Fzd VL chain
RSSQSLLHSNGYNYLD

SEQ ID NO: 2590 - protein, 16 aa, Artificial Sequence
  Made in Lab - CRDL1 from anti-Fzd VL chain
RSSQSLLHSNGYNYLD

SEQ ID NO: 2591 - protein, 11 aa, Artificial Sequence
  Made in Lab - CRDL1 from anti-Fzd VL chain
RASQGIRNDLA

SEQ ID NO: 2592 - protein, 16 aa, Artificial Sequence
  Made in Lab - CRDL1 from anti-Fzd VL chain
RSSQSLLHSNGYNYLD

SEQ ID NO: 2593 - protein, 16 aa, Artificial Sequence
  Made in Lab - CRDL1 from anti-Fzd VL chain
RSSQSLLHSNGYNYLD

SEQ ID NO: 2594 - protein, 16 aa, Artificial Sequence
  Made in Lab - CRDL1 from anti-Fzd VL chain
RSSQSLLHSNGYNYLD

SEQ ID NO: 2595 - protein, 16 aa, Artificial Sequence
  Made in Lab - CRDL1 from anti-Fzd VL chain
RSSQSLLHSNGYNYLD

SEQ ID NO: 2596 - protein, 11 aa, Artificial Sequence
  Made in Lab - CRDL1 from anti-Fzd VL chain
RASQSISSYLN

SEQ ID NO: 2597 - protein, 16 aa, Artificial Sequence
  Made in Lab - CRDL1 from anti-Fzd VL chain
RSSQSLLHSNGYNYLD

SEQ ID NO: 2598 - protein, 16 aa, Artificial Sequence
  Made in Lab - CRDL1 from anti-Fzd VL chain
RSSQSLLHSNGYNYLD

SEQ ID NO: 2599 - protein, 16 aa, Artificial Sequence
  Made in Lab - CRDL1 from anti-Fzd VL chain
RSSQSLLHSNGYNYLD

SEQ ID NO: 2600 - protein, 11 aa, Artificial Sequence
  Made in Lab - CRDL1 from anti-Fzd VL chain
RASQNIGTWLA

SEQ ID NO: 2601 - protein, 16 aa, Artificial Sequence
  Made in Lab - CRDL1 from anti-Fzd VL chain
RSSQSLLHSNGYNYLD

SEQ ID NO: 2602 - protein, 16 aa, Artificial Sequence
  Made in Lab - CRDL1 from anti-Fzd VL chain
RSSQSLLHSNGYNYLD

SEQ ID NO: 2603 - protein, 11 aa, Artificial Sequence
  Made in Lab - CRDL1 from anti-Fzd VL chain
QASQEISNYLN

SEQ ID NO: 2604 - protein, 16 aa, Artificial Sequence
  Made in Lab - CRDL1 from anti-Fzd VL chain
RSSQSLLHSNGYNYLD

SEQ ID NO: 2605 - protein, 17 aa, Artificial Sequence
  Made in Lab - CRDL1 from anti-Fzd VL chain
KSSQSVLYGSNNKNYLA

SEQ ID NO: 2606 - protein, 16 aa, Artificial Sequence
  Made in Lab - CRDL1 from anti-Fzd VL chain
RSSQSLLHSNGYNYLD

SEQ ID NO: 2607 - protein, 17 aa, Artificial Sequence
  Made in Lab - CRDL1 from anti-Fzd VL chain
KSSQSVLYSSNNKNYLA

SEQ ID NO: 2608 - protein, 16 aa, Artificial Sequence
  Made in Lab - CRDL1 from anti-Fzd VL chain
RSSQSLLHSNGYNYLD

SEQ ID NO: 2609 - protein, 11 aa, Artificial Sequence
  Made in Lab - CRDL1 from anti-Fzd VL chain
RASQSINTHLN

SEQ ID NO: 2610 - protein, 11 aa, Artificial Sequence
  Made in Lab - CRDL1 from anti-Fzd VL chain
RASQSISTWLA

SEQ ID NO: 2611 - protein, 16 aa, Artificial Sequence
  Made in Lab - CRDL1 from anti-Fzd VL chain
RSSQSLLHSNGYNYLD

SEQ ID NO: 2612 - protein, 16 aa, Artificial Sequence
  Made in Lab - CRDL1 from anti-Fzd VL chain
RSSQSLLHSNGYNYLD

SEQ ID NO: 2613 - protein, 11 aa, Artificial Sequence
  Made in Lab - CRDL1 from anti-Fzd VL chain
RASQSVSSWLA

SEQ ID NO: 2614 - protein, 16 aa, Artificial Sequence
  Made in Lab - CRDL1 from anti-Fzd VL chain
RSSQSLLHSNGYNYLD

SEQ ID NO: 2615 - protein, 11 aa, Artificial Sequence
  Made in Lab - CRDL1 from anti-Fzd VL chain
RASQGISSYLA

SEQ ID NO: 2616 - protein, 16 aa, Artificial Sequence
  Made in Lab - CRDL1 from anti-Fzd VL chain
RSSQSLLHSNGYNYLD

SEQ ID NO: 2617 - protein, 16 aa, Artificial Sequence
  Made in Lab - CRDL1 from anti-Fzd VL chain
RSSQSLLHSNGYNYLD

SEQ ID NO: 2618 - protein, 11 aa, Artificial Sequence
  Made in Lab - CRDL1 from anti-Fzd VL chain
QASQDISNYLN

SEQ ID NO: 2619 - protein, 11 aa, Artificial Sequence
  Made in Lab - CRDL1 from anti-Fzd VL chain
RASQGVSSYLA

SEQ ID NO: 2620 - protein, 16 aa, Artificial Sequence
  Made in Lab - CRDL1 from anti-Fzd VL chain
RSSQSLLHSNGYNYLD

SEQ ID NO: 2621 - protein, 11 aa, Artificial Sequence
  Made in Lab - CRDL1 from anti-Fzd VL chain
RASQSISSWLA

SEQ ID NO: 2622 - protein, 11 aa, Artificial Sequence
  Made in Lab - CRDL1 from anti-Fzd VL chain
QASQDIGNYLN

SEQ ID NO: 2623 - protein, 11 aa, Artificial Sequence
  Made in Lab - CRDL1 from anti-Fzd VL chain
RASQGISNYLN

SEQ ID NO: 2624 - protein, 11 aa, Artificial Sequence
  Made in Lab - CRDL1 from anti-Fzd VL chain
RVSQGISNYLA

SEQ ID NO: 2625 - protein, 16 aa, Artificial Sequence
  Made in Lab - CRDL1 from anti-Fzd VL chain
RSSQSLLHSNGYNYLD

SEQ ID NO: 2626 - protein, 11 aa, Artificial Sequence
  Made in Lab - CRDL1 from anti-Fzd VL chain
RASQSISRWLA

SEQ ID NO: 2627 - protein, 16 aa, Artificial Sequence
  Made in Lab - CRDL1 from anti-Fzd VL chain
RSSQSLLHSNGYNYLD

SEQ ID NO: 2628 - protein, 11 aa, Artificial Sequence
  Made in Lab - CRDL1 from anti-Fzd VL chain
  misc_feature (1)..(1): Xaa can be any naturally occurring amino acid
XASQDISNYLN

SEQ ID NO: 2629 - protein, 16 aa, Artificial Sequence
  Made in Lab - CRDL1 from anti-Fzd VL chain
RSSQSLLHSNGYNYLD

SEQ ID NO: 2630 - protein, 11 aa, Artificial Sequence
  Made in Lab - CRDL1 from anti-Fzd VL chain
RASQSINNWLA

SEQ ID NO: 2631 - protein, 16 aa, Artificial Sequence
  Made in Lab - CRDL1 from anti-Fzd VL chain
RSSQSLLHSNGYNYLD

SEQ ID NO: 2632 - protein, 16 aa, Artificial Sequence
  Made in Lab - CRDL1 from anti-Fzd VL chain
RSSQSLLHSNGYNYLD

SEQ ID NO: 2633 - protein, 16 aa, Artificial Sequence
  Made in Lab - CRDL1 from anti-Fzd VL chain
RSSQSLLHSNGYNYLD

SEQ ID NO: 2634 - protein, 16 aa, Artificial Sequence
  Made in Lab - CRDL1 from anti-Fzd VL chain
RSSQSLLHSNGYNYLD

SEQ ID NO: 2635 - protein, 11 aa, Artificial Sequence
  Made in Lab - CRDL1 from anti-Fzd VL chain
RASQNISSYLN

SEQ ID NO: 2636 - protein, 11 aa, Artificial Sequence
  Made in Lab - CRDL1 from anti-Fzd VL chain
RASQGISSHLA

SEQ ID NO: 2637 - protein, 16 aa, Artificial Sequence
  Made in Lab - CRDL1 from anti-Fzd VL chain
RSSQSLLHSNGYNYLD

SEQ ID NO: 2638 - protein, 11 aa, Artificial Sequence
  Made in Lab - CRDL1 from anti-Fzd VL chain
RASQAISNYLV

SEQ ID NO: 2639 - protein, 17 aa, Artificial Sequence
  Made in Lab - CRDL1 from anti-Fzd VL chain
KSSQSVLYSSNNKNYLA

SEQ ID NO: 2640 - protein, 16 aa, Artificial Sequence
  Made in Lab - CRDL1 from anti-Fzd VL chain
RSSQSLLHSNGYNYLD

SEQ ID NO: 2641 - protein, 16 aa, Artificial Sequence
  Made in Lab - CRDL1 from anti-Fzd VL chain
RSSQSLLHSNGYNYLD

SEQ ID NO: 2642 - protein, 17 aa, Artificial Sequence
  Made in Lab - CRDL1 from anti-Fzd VL chain
KSSQSVLYSSNNKNYLA

SEQ ID NO: 2643 - protein, 11 aa, Artificial Sequence
  Made in Lab - CRDL1 from anti-Fzd VL chain
RASQSISSYLN

SEQ ID NO: 2644 - protein, 16 aa, Artificial Sequence
  Made in Lab - CRDL1 from anti-Fzd VL chain
RSSQSLLHSNGYNYLD

SEQ ID NO: 2645 - protein, 16 aa, Artificial Sequence
  Made in Lab - CRDL1 from anti-Fzd VL chain
RSSQSLLHSNGYNYLD

SEQ ID NO: 2646 - protein, 16 aa, Artificial Sequence
  Made in Lab - CRDL1 from anti-Fzd VL chain
RSSQSLLHSNGYNYLD

SEQ ID NO: 2647 - protein, 16 aa, Artificial Sequence
  Made in Lab - CRDL1 from anti-Fzd VL chain
RSSQSLLHSNGYNYLD

SEQ ID NO: 2648 - protein, 16 aa, Artificial Sequence
  Made in Lab - CRDL1 from anti-Fzd VL chain
RSSQSLLHSNGYNYLD

SEQ ID NO: 2649 - protein, 16 aa, Artificial Sequence
  Made in Lab - CRDL1 from anti-Fzd VL chain
RSSQSLLHSNGYNYLD

SEQ ID NO: 2650 - protein, 16 aa, Artificial Sequence
  Made in Lab - CRDL1 from anti-Fzd VL chain
KSSQSLLDSDGKTYLN

SEQ ID NO: 2651 - protein, 11 aa, Artificial Sequence
  Made in Lab - CRDL1 from anti-Fzd VL chain
RASQGITKSLA

SEQ ID NO: 2652 - protein, 16 aa, Artificial Sequence
  Made in Lab - CRDL1 from anti-Fzd VL chain
RSSRSLLHSDGNTYLH

SEQ ID NO: 2653 - protein, 11 aa, Artificial Sequence
  Made in Lab - CRDL1 from anti-Fzd VL chain
QASQDISNYLN

SEQ ID NO: 2654 - protein, 16 aa, Artificial Sequence
  Made in Lab - CRDL1 from anti-Fzd VL chain
RSSQSLRVSNGAZYLD

SEQ ID NO: 2655 - protein, 11 aa, Artificial Sequence
  Made in Lab - CRDL1 from anti-Fzd VL chain
RASQZISRWLA

SEQ ID NO: 2656 - protein, 11 aa, Artificial Sequence
  Made in Lab - CRDL1 from anti-Fzd VL chain
QASQDISZYLT

SEQ ID NO: 2657 - protein, 16 aa, Artificial Sequence
  Made in Lab - CRDL1 from anti-Fzd VL chain
RSSQSLLHSNGYNYLD

SEQ ID NO: 2658 - protein, 11 aa, Artificial Sequence
  Made in Lab - CRDL1 from anti-Fzd VL chain
RASQGISNNLN

SEQ ID NO: 2659 - protein, 11 aa, Artificial Sequence
  Made in Lab - CRDL1 from anti-Fzd VL chain
RASQGISNYLA

SEQ ID NO: 2660 - protein, 16 aa, Artificial Sequence
  Made in Lab - CRDL1 from anti-Fzd VL chain
RSSQSLLHSNGYNYLD

SEQ ID NO: 2661 - protein, 11 aa, Artificial Sequence
  Made in Lab - CRDL1 from anti-Fzd VL chain
RASQSISRWLA

SEQ ID NO: 2662 - protein, 11 aa, Artificial Sequence
  Made in Lab - CRDL1 from anti-Fzd VL chain
RASQSISSWLA

SEQ ID NO: 2663 - protein, 17 aa, Artificial Sequence
  Made in Lab - CRDL1 from anti-Fzd VL chain
RSSQSVLYSSNNKNYLA

SEQ ID NO: 2664 - protein, 17 aa, Artificial Sequence
  Made in Lab - CRDL1 from anti-Fzd VL chain
KSSQSVLYSSNNKNYLA

SEQ ID NO: 2665 - protein, 11 aa, Artificial Sequence
  Made in Lab - CRDL1 from anti-Fzd VL chain
RASQNINNWLA

SEQ ID NO: 2666 - protein, 11 aa, Artificial Sequence
  Made in Lab - CRDL1 from anti-Fzd VL chain
QZSQDISNYLN

SEQ ID NO: 2667 - protein, 11 aa, Artificial Sequence
  Made in Lab - CRDL1 from anti-Fzd VL chain
RASQSINRWLA

SEQ ID NO: 2668 - protein, 16 aa, Artificial Sequence
  Made in Lab - CRDL1 from anti-Fzd VL chain
RSSQSLLHSNGYNYLD

SEQ ID NO: 2669 - protein, 11 aa, Artificial Sequence
  Made in Lab - CRDL1 from anti-Fzd VL chain
RASQSINRWLA

SEQ ID NO: 2670 - protein, 17 aa, Artificial Sequence
  Made in Lab - CRDL1 from anti-Fzd VL chain
KSZQZVLYZSNNKNYLZ

SEQ ID NO: 2671 - protein, 11 aa, Artificial Sequence
  Made in Lab - CRDL1 from anti-Fzd VL chain
RASQSISSYLN

SEQ ID NO: 2672 - protein, 11 aa, Artificial Sequence
  Made in Lab - CRDL1 from anti-Fzd VL chain
RASQSISRWLA

SEQ ID NO: 2673 - protein, 11 aa, Artificial Sequence
  Made in Lab - CRDL1 from anti-Fzd VL chain
RASQSINZZLA

SEQ ID NO: 2674 - protein, 11 aa, Artificial Sequence
  Made in Lab - CRDL1 from anti-Fzd VL chain
RASQSISSWLA

SEQ ID NO: 2675 - protein, 11 aa, Artificial Sequence
  Made in Lab - CRDL1 from anti-Fzd VL chain
RASQSISRWLA

SEQ ID NO: 2676 - protein, 11 aa, Artificial Sequence
  Made in Lab - CRDL1 from anti-Fzd VL chain
RASQSINRWLA

SEQ ID NO: 2677 - protein, 11 aa, Artificial Sequence
  Made in Lab - CRDL1 from anti-Fzd VL chain
RASZGISNZLN

SEQ ID NO: 2678 - protein, 17 aa, Artificial Sequence
  Made in Lab - CRDL1 from anti-Fzd VL chain
KSSQSVLYSSNNKNYLA

SEQ ID NO: 2679 - protein, 11 aa, Artificial Sequence
  Made in Lab - CRDL1 from anti-Fzd VL chain
RASQSISTWLA

SEQ ID NO: 2680 - protein, 11 aa, Artificial Sequence
  Made in Lab - CRDL1 from anti-Fzd VL chain
RASQSISRWLA

SEQ ID NO: 2681 - protein, 11 aa, Artificial Sequence
  Made in Lab - CRDL1 from anti-Fzd VL chain
RASQGISNNLN

SEQ ID NO: 2682 - protein, 11 aa, Artificial Sequence
  Made in Lab - CRDL1 from anti-Fzd VL chain
QASQDISNYLN

SEQ ID NO: 2683 - protein, 17 aa, Artificial Sequence
  Made in Lab - CRDL1 from anti-Fzd VL chain
KSSQSVLYSSNNKNYLA

SEQ ID NO: 2684 - protein, 11 aa, Artificial Sequence
  Made in Lab - CRDL1 from anti-Fzd VL chain
RASQSINZYLA

SEQ ID NO: 2685 - protein, 11 aa, Artificial Sequence
  Made in Lab - CRDL1 from anti-Fzd VL chain
RASQSIASYLN

SEQ ID NO: 2686 - protein, 11 aa, Artificial Sequence
  Made in Lab - CRDL1 from anti-Fzd VL chain
RASZZISSYLZ

SEQ ID NO: 2687 - protein, 11 aa, Artificial Sequence
  Made in Lab - CRDL1 from anti-Fzd VL chain
RASQGISSYLA

SEQ ID NO: 2688 - protein, 16 aa, Artificial Sequence
  Made in Lab - CRDL1 from anti-Fzd VL chain
RSSQSLLHSNGYNYLD

SEQ ID NO: 2689 - protein, 11 aa, Artificial Sequence
  Made in Lab - CRDL1 from anti-Fzd VL chain
RASQSVGHFLA

SEQ ID NO: 2690 - protein, 11 aa, Artificial Sequence
  Made in Lab - CRDL1 from anti-Fzd VL chain
ZASQDIZNYLN

SEQ ID NO: 2691 - protein, 11 aa, Artificial Sequence
  Made in Lab - CRDL1 from anti-Fzd VL chain
RVSQGISSYLN

SEQ ID NO: 2692 - protein, 11 aa, Artificial Sequence
  Made in Lab - CRDL1 from anti-Fzd VL chain
QASQDISNYLN

SEQ ID NO: 2693 - protein, 11 aa, Artificial Sequence
  Made in Lab - CRDL1 from anti-Fzd VL chain
RASQGISNYLA

SEQ ID NO: 2694 - protein, 11 aa, Artificial Sequence
  Made in Lab - CRDL1 from anti-Fzd VL chain
QASQDISNYLN

SEQ ID NO: 2695 - protein, 11 aa, Artificial Sequence
  Made in Lab - CRDL1 from anti-Fzd VL chain
QASQDISNYLN

SEQ ID NO: 2696 - protein, 17 aa, Artificial Sequence
  Made in Lab - CRDL1 from anti-Fzd VL chain
KSSQTVLYNSNNKNYLA

SEQ ID NO: 2697 - protein, 11 aa, Artificial Sequence
  Made in Lab - CRDL1 from anti-Fzd VL chain
RASQSISTWLA

SEQ ID NO: 2698 - protein, 17 aa, Artificial Sequence
  Made in Lab - CRDL1 from anti-Fzd VL chain
KSSQSVLYNSNNKNYLA

SEQ ID NO: 2699 - protein, 11 aa, Artificial Sequence
  Made in Lab - CRDL1 from anti-Fzd VL chain
RASQGISNNLN

SEQ ID NO: 2700 - protein, 11 aa, Artificial Sequence
  Made in Lab - CRDL1 from anti-Fzd VL chain
RASQGISNYLA

SEQ ID NO: 2701 - protein, 11 aa, Artificial Sequence
  Made in Lab - CRDL1 from anti-Fzd VL chain
RASENINSWLA

SEQ ID NO: 2702 - protein, 11 aa, Artificial Sequence
  Made in Lab - CRDL1 from anti-Fzd VL chain
RASQGISSWLA

SEQ ID NO: 2703 - protein, 11 aa, Artificial Sequence
  Made in Lab - CRDL1 from anti-Fzd VL chain
LSSSNNNNYLA

SEQ ID NO: 2704 - protein, 11 aa, Artificial Sequence
  Made in Lab - CRDL1 from anti-Fzd VL chain
RASQZISNNLN

SEQ ID NO: 2705 - protein, 16 aa, Artificial Sequence
  Made in Lab - CRDL1 from anti-Fzd VL chain
RSSQSLLHSNGYNYLD

SEQ ID NO: 2706 - protein, 17 aa, Artificial Sequence
  Made in Lab - CRDL1 from anti-Fzd VL chain
KSSQSVLYSSNNKNYLA

SEQ ID NO: 2707 - protein, 11 aa, Artificial Sequence
  Made in Lab - CRDL1 from anti-Fzd VL chain
RASQFISSWLA

SEQ ID NO: 2708 - protein, 11 aa, Artificial Sequence
  Made in Lab - CRDL1 from anti-Fzd VL chain
QASQDISNYLN

SEQ ID NO: 2709 - protein, 11 aa, Artificial Sequence
  Made in Lab - CRDL1 from anti-Fzd VL chain
RASQSISRWLA

SEQ ID NO: 2710 - protein, 11 aa, Artificial Sequence
  Made in Lab - CRDL1 from anti-Fzd VL chain
RASQSISRWLA

SEQ ID NO: 2711 - protein, 17 aa, Artificial Sequence
  Made in Lab - CRDL1 from anti-Fzd VL chain
KSSQSVLYSSNNKNYLA

SEQ ID NO: 2712 - protein, 11 aa, Artificial Sequence
  Made in Lab - CRDL1 from anti-Fzd VL chain
RASESIGSWLA

SEQ ID NO: 2713 - protein, 11 aa, Artificial Sequence
  Made in Lab - CRDL1 from anti-Fzd VL chain
RASQGISNNLN

SEQ ID NO: 2714 - protein, 11 aa, Artificial Sequence
  Made in Lab - CRDL1 from anti-Fzd VL chain
RASQSISZWLA

SEQ ID NO: 2715 - protein, 11 aa, Artificial Sequence
  Made in Lab - CRDL1 from anti-Fzd VL chain
RASQGISNNLN

SEQ ID NO: 2716 - protein, 11 aa, Artificial Sequence
  Made in Lab - CRDL1 from anti-Fzd VL chain
RASQEISSWLA

SEQ ID NO: 2717 - protein, 11 aa, Artificial Sequence
  Made in Lab - CRDL1 from anti-Fzd VL chain
RASZZISNNLN

SEQ ID NO: 2718 - protein, 11 aa, Artificial Sequence
  Made in Lab - CRDL1 from anti-Fzd VL chain
RASQSISSWLA

SEQ ID NO: 2719 - protein, 11 aa, Artificial Sequence
  Made in Lab - CRDL1 from anti-Fzd VL chain
QASQDISNYLN

SEQ ID NO: 2720 - protein, 11 aa, Artificial Sequence
  Made in Lab - CRDL1 from anti-Fzd VL chain
RASZGISNNLN

SEQ ID NO: 2721 - protein, 11 aa, Artificial Sequence
  Made in Lab - CRDL1 from anti-Fzd VL chain
RASQDITNYLN

SEQ ID NO: 2722 - protein, 17 aa, Artificial Sequence
  Made in Lab - CRDL1 from anti-Fzd VL chain
KSSQSVLYSSNNKNYLA

SEQ ID NO: 2723 - protein, 11 aa, Artificial Sequence
  Made in Lab - CRDL1 from anti-Fzd VL chain
RASQSINRWLA

SEQ ID NO: 2724 - protein, 11 aa, Artificial Sequence
  Made in Lab - CRDL1 from anti-Fzd VL chain
RASQGISNNLN

SEQ ID NO: 2725 - protein, 11 aa, Artificial Sequence
  Made in Lab - CRDL1 from anti-Fzd VL chain
RASQGISNYLA

SEQ ID NO: 2726 - protein, 11 aa, Artificial Sequence
  Made in Lab - CRDL1 from anti-Fzd VL chain
RASQSINRWLA

SEQ ID NO: 2727 - protein, 11 aa, Artificial Sequence
  Made in Lab - CRDL1 from anti-Fzd VL chain
RASQSISSYLN

SEQ ID NO: 2728 - protein, 16 aa, Artificial Sequence
  Made in Lab - CRDL1 from anti-Fzd VL chain
RSSQSLZHSNGYNYLD

SEQ ID NO: 2729 - protein, 17 aa, Artificial Sequence
  Made in Lab - CRDL1 from anti-Fzd VL chain
KSSQSVLYSSNNKNYLA

SEQ ID NO: 2730 - protein, 11 aa, Artificial Sequence
  Made in Lab - CRDL1 from anti-Fzd VL chain
RASQSIGYWLA

SEQ ID NO: 2731 - protein, 11 aa, Artificial Sequence
  Made in Lab - CRDL1 from anti-Fzd VL chain
RASQGISNNLN

SEQ ID NO: 2732 - protein, 11 aa, Artificial Sequence
  Made in Lab - CRDL1 from anti-Fzd VL chain
RASQSITRWLA

SEQ ID NO: 2733 - protein, 11 aa, Artificial Sequence
  Made in Lab - CRDL1 from anti-Fzd VL chain
RASQSISRWLA

SEQ ID NO: 2734 - protein, 11 aa, Artificial Sequence
  Made in Lab - CRDL1 from anti-Fzd VL chain
RASZZISNZLN

SEQ ID NO: 2735 - protein, 11 aa, Artificial Sequence
  Made in Lab - CRDL1 from anti-Fzd VL chain
RASQGIDNWLA

SEQ ID NO: 2736 - protein, 11 aa, Artificial Sequence
  Made in Lab - CRDL1 from anti-Fzd VL chain
RASQSISSYLN

SEQ ID NO: 2737 - protein, 11 aa, Artificial Sequence
  Made in Lab - CRDL1 from anti-Fzd VL chain
RASQSISTYLN

SEQ ID NO: 2738 - protein, 11 aa, Artificial Sequence
  Made in Lab - CRDL1 from anti-Fzd VL chain
RASQSISRWLA

SEQ ID NO: 2739 - protein, 11 aa, Artificial Sequence
  Made in Lab - CRDL1 from anti-Fzd VL chain
RASQNIATYLN

SEQ ID NO: 2740 - protein, 11 aa, Artificial Sequence
  Made in Lab - CRDL1 from anti-Fzd VL chain
RASQEISSWLA

SEQ ID NO: 2741 - protein, 16 aa, Artificial Sequence
  Made in Lab - CRDL1 from anti-Fzd VL chain
RSSQSLLHSNGYNYLD

SEQ ID NO: 2742 - protein, 11 aa, Artificial Sequence
  Made in Lab - CRDL1 from anti-Fzd VL chain
RASQSIYRWLZ

SEQ ID NO: 2743 - protein, 11 aa, Artificial Sequence
  Made in Lab - CRDL1 from anti-Fzd VL chain
RAZQGISNNLN

SEQ ID NO: 2744 - protein, 11 aa, Artificial Sequence
  Made in Lab - CRDL1 from anti-Fzd VL chain
RASQSIYRWLA

SEQ ID NO: 2745 - protein, 11 aa, Artificial Sequence
  Made in Lab - CRDL1 from anti-Fzd VL chain
RASQGISIYLA

SEQ ID NO: 2746 - protein, 17 aa, Artificial Sequence
  Made in Lab - CRDL1 from anti-Fzd VL chain
KSSQSVLYSSNNKNYLA

SEQ ID NO: 2747 - protein, 11 aa, Artificial Sequence
  Made in Lab - CRDL1 from anti-Fzd VL chain
RASQSISSWLA

SEQ ID NO: 2748 - protein, 11 aa, Artificial Sequence
  Made in Lab - CRDL1 from anti-Fzd VL chain
RASQSIGSWLA

SEQ ID NO: 2749 - protein, 11 aa, Artificial Sequence
  Made in Lab - CRDL1 from anti-Fzd VL chain
RASQSITRWLA

SEQ ID NO: 2750 - protein, 17 aa, Artificial Sequence
  Made in Lab - CRDL1 from anti-Fzd VL chain
KSSQSVLYSSNNKNYLA

SEQ ID NO: 2751 - protein, 16 aa, Artificial Sequence
  Made in Lab - CRDL1 from anti-Fzd VL chain
RSSQSLLHSNGYNYLD

SEQ ID NO: 2752 - protein, 16 aa, Artificial Sequence
  Made in Lab - CRDL1 from anti-Fzd VL chain
RSSQSLLHSNGYNYLD

SEQ ID NO: 2753 - protein, 11 aa, Artificial Sequence
  Made in Lab - CRDL1 from anti-Fzd VL chain
QASQDISNYLN

SEQ ID NO: 2754 - protein, 11 aa, Artificial Sequence
  Made in Lab - CRDL1 from anti-Fzd VL chain
RASQSISRWLA

SEQ ID NO: 2755 - protein, 16 aa, Artificial Sequence
  Made in Lab - CRDL1 from anti-Fzd VL chain
RSSQSLLHSNGYNYLD

SEQ ID NO: 2756 - protein, 11 aa, Artificial Sequence
  Made in Lab - CRDL1 from anti-Fzd VL chain
RASQSISSYLN

SEQ ID NO: 2757 - protein, 16 aa, Artificial Sequence
  Made in Lab - CRDL1 from anti-Fzd VL chain
RSSQSLLHSNGYNYLD

SEQ ID NO: 2758 - protein, 16 aa, Artificial Sequence
  Made in Lab - CRDL1 from anti-Fzd VL chain
RSSQSLLHSNGYNYLD

SEQ ID NO: 2759 - protein, 11 aa, Artificial Sequence
  Made in Lab - CRDL1 from anti-Fzd VL chain
RASQSISTWLA

SEQ ID NO: 2760 - protein, 11 aa, Artificial Sequence
  Made in Lab - CRDL1 from anti-Fzd VL chain
RASQGISSYLA

SEQ ID NO: 2761 - protein, 16 aa, Artificial Sequence
  Made in Lab - CRDL1 from anti-Fzd VL chain
RSSQSLLHSNGYNYLD

SEQ ID NO: 2762 - protein, 16 aa, Artificial Sequence
  Made in Lab - CRDL1 from anti-Fzd VL chain
RSSQSLLHSNGYNYLD

SEQ ID NO: 2763 - protein, 16 aa, Artificial Sequence
  Made in Lab - CRDL1 from anti-Fzd VL chain
RSSQSLLHSNGYNYLD

SEQ ID NO: 2764 - protein, 11 aa, Artificial Sequence
  Made in Lab - CRDL1 from anti-Fzd VL chain
RASQSISSWLA

SEQ ID NO: 2765 - protein, 16 aa, Artificial Sequence
  Made in Lab - CRDL1 from anti-Fzd VL chain
RSSQSLLHSNGYNYLD

SEQ ID NO: 2766 - protein, 11 aa, Artificial Sequence
  Made in Lab - CRDL1 from anti-Fzd VL chain
RASQSISSYLN

SEQ ID NO: 2767 - protein, 17 aa, Artificial Sequence
  Made in Lab - CRDL1 from anti-Fzd VL chain
KSSQSVLYSSNNKNYLA

SEQ ID NO: 2768 - protein, 16 aa, Artificial Sequence
  Made in Lab - CRDL1 from anti-Fzd VL chain
RSSQSLLHSNGYNYLD

SEQ ID NO: 2769 - protein, 11 aa, Artificial Sequence
  Made in Lab - CRDL1 from anti-Fzd VL chain
RASQGISSYLA

SEQ ID NO: 2770 - protein, 16 aa, Artificial Sequence
  Made in Lab - CRDL1 from anti-Fzd VL chain
RSSQSLLHSNGYNYLD

SEQ ID NO: 2771 - protein, 16 aa, Artificial Sequence
  Made in Lab - CRDL1 from anti-Fzd VL chain
RSSQSLLHSNGYNYLD

SEQ ID NO: 2772 - protein, 11 aa, Artificial Sequence
  Made in Lab - CRDL1 from anti-Fzd VL chain
RASQSISSWLA

SEQ ID NO: 2773 - protein, 16 aa, Artificial Sequence
  Made in Lab - CRDL1 from anti-Fzd VL chain
RSSQSLLHSNGYNYLD

SEQ ID NO: 2774 - protein, 17 aa, Artificial Sequence
  Made in Lab - CRDL1 from anti-Fzd VL chain
KSSQSVLYSSNNKNYLA

SEQ ID NO: 2775 - protein, 11 aa, Artificial Sequence
  Made in Lab - CRDL1 from anti-Fzd VL chain
RASQSISSWLA

SEQ ID NO: 2776 - protein, 11 aa, Artificial Sequence
  Made in Lab - CRDL1 from anti-Fzd VL chain
QASQDISNYLN

SEQ ID NO: 2777 - protein, 16 aa, Artificial Sequence
  Made in Lab - CRDL1 from anti-Fzd VL chain
RSSQSLLHSNGYNYLD

SEQ ID NO: 2778 - protein, 11 aa, Artificial Sequence
  Made in Lab - CRDL1 from anti-Fzd VL chain
RASQSISSWLA

SEQ ID NO: 2779 - protein, 11 aa, Artificial Sequence
  Made in Lab - CRDL1 from anti-Fzd VL chain
RASQSISRWLA

SEQ ID NO: 2780 - protein, 11 aa, Artificial Sequence
  Made in Lab - CRDL1 from anti-Fzd VL chain
RASQGISNYLA

SEQ ID NO: 2781 - protein, 11 aa, Artificial Sequence
  Made in Lab - CRDL1 from anti-Fzd VL chain
RASQSISSYLN

SEQ ID NO: 2782 - protein, 16 aa, Artificial Sequence
  Made in Lab - CRDL1 from anti-Fzd VL chain
RSSQSLLHSNGYNYLD

SEQ ID NO: 2783 - protein, 16 aa, Artificial Sequence
  Made in Lab - CRDL1 from anti-Fzd VL chain
RSSQSLLHSNGYNYLD

SEQ ID NO: 2784 - protein, 16 aa, Artificial Sequence
  Made in Lab - CRDL1 from anti-Fzd VL chain
RSSQSLLHSNGYNYLD

SEQ ID NO: 2785 - protein, 16 aa, Artificial Sequence
  Made in Lab - CRDL1 from anti-Fzd VL chain
RSSQSLLHSNGYNYLD

SEQ ID NO: 2786 - protein, 16 aa, Artificial Sequence
  Made in Lab - CRDL1 from anti-Fzd VL chain
RSSQSLLHSNGYNYLD

SEQ ID NO: 2787 - protein, 16 aa, Artificial Sequence
  Made in Lab - CRDL1 from anti-Fzd VL chain
RSSQSLLHSNGYNYLD

SEQ ID NO: 2788 - protein, 11 aa, Artificial Sequence
  Made in Lab - CRDL1 from anti-Fzd VL chain
RASQSISSYLN

SEQ ID NO: 2789 - protein, 11 aa, Artificial Sequence
  Made in Lab - CRDL1 from anti-Fzd VL chain
QASQDISNYLN

SEQ ID NO: 2790 - protein, 11 aa, Artificial Sequence
  Made in Lab - CRDL1 from anti-Fzd VL chain
RASQSISSWLA

SEQ ID NO: 2791 - protein, 11 aa, Artificial Sequence
  Made in Lab - CRDL1 from anti-Fzd VL chain
RASQGISSWLA

SEQ ID NO: 2792 - protein, 16 aa, Artificial Sequence
  Made in Lab - CRDL1 from anti-Fzd VL chain
RSSQSLLHSNGYNYLD

SEQ ID NO: 2793 - protein, 11 aa, Artificial Sequence
  Made in Lab - CRDL1 from anti-Fzd VL chain
RASQSISSYLN

SEQ ID NO: 2794 - protein, 16 aa, Artificial Sequence
  Made in Lab - CRDL1 from anti-Fzd VL chain
RSSQSLLHSNGYNYLD

SEQ ID NO: 2795 - protein, 11 aa, Artificial Sequence
  Made in Lab - CRDL1 from anti-Fzd VL chain
RASQGISNYLA

SEQ ID NO: 2796 - protein, 11 aa, Artificial Sequence
  Made in Lab - CRDL1 from anti-Fzd VL chain
RASQSISSWLA

SEQ ID NO: 2797 - protein, 16 aa, Artificial Sequence
  Made in Lab - CRDL1 from anti-Fzd VL chain
RSSQSLLHSNGYNYLD

SEQ ID NO: 2798 - protein, 16 aa, Artificial Sequence
  Made in Lab - CRDL1 from anti-Fzd VL chain
RSSQSLLHSNGYNYLD

SEQ ID NO: 2799 - protein, 11 aa, Artificial Sequence
  Made in Lab - CRDL1 from anti-Fzd VL chain
RASQSISSWLA

SEQ ID NO: 2800 - protein, 11 aa, Artificial Sequence
  Made in Lab - CRDL1 from anti-Fzd VL chain
RASQSISTYLN

SEQ ID NO: 2801 - protein, 16 aa, Artificial Sequence
  Made in Lab - CRDL1 from anti-Fzd VL chain
RSSQSLLHSNGYNYLD

SEQ ID NO: 2802 - protein, 16 aa, Artificial Sequence
  Made in Lab - CRDL1 from anti-Fzd VL chain
RSSQSLLHSNGYNYLD

SEQ ID NO: 2803 - protein, 11 aa, Artificial Sequence
  Made in Lab - CRDL1 from anti-Fzd VL chain
RASQSISSWLA

SEQ ID NO: 2804 - protein, 11 aa, Artificial Sequence
  Made in Lab - CRDL1 from anti-Fzd VL chain
RASQGISNYLA

SEQ ID NO: 2805 - protein, 16 aa, Artificial Sequence
  Made in Lab - CRDL1 from anti-Fzd VL chain
RSSQSLLHSNGYNYLD

SEQ ID NO: 2806 - protein, 16 aa, Artificial Sequence
  Made in Lab - CRDL1 from anti-Fzd VL chain
RSSQSLLHSNGYNYLD

SEQ ID NO: 2807 - protein, 11 aa, Artificial Sequence
  Made in Lab - CRDL1 from anti-Fzd VL chain
RASQSISTYLN

SEQ ID NO: 2808 - protein, 11 aa, Artificial Sequence
  Made in Lab - CRDL1 from anti-Fzd VL chain
QASQDISNYLN

SEQ ID NO: 2809 - protein, 11 aa, Artificial Sequence
  Made in Lab - CRDL1 from anti-Fzd VL chain
RASQGISSWLA

SEQ ID NO: 2810 - protein, 16 aa, Artificial Sequence
  Made in Lab - CRDL1 from anti-Fzd VL chain
RSSQSLLHSNGYNYLD

SEQ ID NO: 2811 - protein, 11 aa, Artificial Sequence
  Made in Lab - CRDL1 from anti-Fzd VL chain
RASQSISSWLA

SEQ ID NO: 2812 - protein, 17 aa, Artificial Sequence
  Made in Lab - CRDL1 from anti-Fzd VL chain
KSSQSVLYSSNNKNYLA

SEQ ID NO: 2813 - protein, 16 aa, Artificial Sequence
  Made in Lab - CRDL1 from anti-Fzd VL chain
RSSQSLLHSNGYNYLD

SEQ ID NO: 2814 - protein, 16 aa, Artificial Sequence
  Made in Lab - CRDL1 from anti-Fzd VL chain
RSSQSLLHSNGYNYLD

SEQ ID NO: 2815 - protein, 16 aa, Artificial Sequence
  Made in Lab - CRDL1 from anti-Fzd VL chain
RSSQSLLHSNGYNYLD

SEQ ID NO: 2816 - protein, 7 aa, Artificial Sequence
  Made in Lab - CRDL2 from anti-Fzd VL chain
GASTLQS

SEQ ID NO: 2817 - protein, 7 aa, Artificial Sequence
  Made in Lab - CRDL2 from anti-Fzd VL chain
RASSLES

SEQ ID NO: 2818 - protein, 7 aa, Artificial Sequence
  Made in Lab - CRDL2 from anti-Fzd VL chain
LGSKRAS

SEQ ID NO: 2819 - protein, 7 aa, Artificial Sequence
  Made in Lab - CRDL2 from anti-Fzd VL chain
GASSLQN

SEQ ID NO: 2820 - protein, 7 aa, Artificial Sequence
  Made in Lab - CRDL2 from anti-Fzd VL chain
LGSSRAS

SEQ ID NO: 2821 - protein, 7 aa, Artificial Sequence
  Made in Lab - CRDL2 from anti-Fzd VL chain
LGSNRAS

SEQ ID NO: 2822 - protein, 7 aa, Artificial Sequence
  Made in Lab - CRDL2 from anti-Fzd VL chain
MGSNRAS

SEQ ID NO: 2823 - protein, 7 aa, Artificial Sequence
  Made in Lab - CRDL2 from anti-Fzd VL chain
LGSNRAS

SEQ ID NO: 2824 - protein, 7 aa, Artificial Sequence
  Made in Lab - CRDL2 from anti-Fzd VL chain
LGSNRAS

SEQ ID NO: 2825 - protein, 7 aa, Artificial Sequence
  Made in Lab - CRDL2 from anti-Fzd VL chain
LGSNRAS

SEQ ID NO: 2826 - protein, 7 aa, Artificial Sequence
  Made in Lab - CRDL2 from anti-Fzd VL chain
LGSNRAS

SEQ ID NO: 2827 - protein, 7 aa, Artificial Sequence
  Made in Lab - CRDL2 from anti-Fzd VL chain
LGSHRAS

SEQ ID NO: 2828 - protein, 7 aa, Artificial Sequence
  Made in Lab - CRDL2 from anti-Fzd VL chain
LGSNRAS

SEQ ID NO: 2829 - protein, 7 aa, Artificial Sequence
  Made in Lab - CRDL2 from anti-Fzd VL chain
FGSNRAS

SEQ ID NO: 2830 - protein, 7 aa, Artificial Sequence
  Made in Lab - CRDL2 from anti-Fzd VL chain
QGSNRAS

SEQ ID NO: 2831 - protein, 7 aa, Artificial Sequence
  Made in Lab - CRDL2 from anti-Fzd VL chain
DASNLET

SEQ ID NO: 2832 - protein, 7 aa, Artificial Sequence
  Made in Lab - CRDL2 from anti-Fzd VL chain
AASTLQT

SEQ ID NO: 2833 - protein, 7 aa, Artificial Sequence
  Made in Lab - CRDL2 from anti-Fzd VL chain
LGSIRAS

SEQ ID NO: 2834 - protein, 7 aa, Artificial Sequence
  Made in Lab - CRDL2 from anti-Fzd VL chain
LGSNRAS

SEQ ID NO: 2835 - protein, 7 aa, Artificial Sequence
  Made in Lab - CRDL2 from anti-Fzd VL chain
LGSNRAS

SEQ ID NO: 2836 - protein, 7 aa, Artificial Sequence
  Made in Lab - CRDL2 from anti-Fzd VL chain
LGSNRAA

SEQ ID NO: 2837 - protein, 7 aa, Artificial Sequence
  Made in Lab - CRDL2 from anti-Fzd VL chain
LGSHRAS

SEQ ID NO: 2838 - protein, 7 aa, Artificial Sequence
  Made in Lab - CRDL2 from anti-Fzd VL chain
LGSNRAS

SEQ ID NO: 2839 - protein, 7 aa, Artificial Sequence
  Made in Lab - CRDL2 from anti-Fzd VL chain
LGSNRAS

SEQ ID NO: 2840 - protein, 7 aa, Artificial Sequence
  Made in Lab - CRDL2 from anti-Fzd VL chain
LGSNRAS

SEQ ID NO: 2841 - protein, 7 aa, Artificial Sequence
  Made in Lab - CRDL2 from anti-Fzd VL chain
LGSNRAS

SEQ ID NO: 2842 - protein, 7 aa, Artificial Sequence
  Made in Lab - CRDL2 from anti-Fzd VL chain
LGSNRAS

SEQ ID NO: 2843 - protein, 7 aa, Artificial Sequence
  Made in Lab - CRDL2 from anti-Fzd VL chain
AASSLQS

SEQ ID NO: 2844 - protein, 7 aa, Artificial Sequence
  Made in Lab - CRDL2 from anti-Fzd VL chain
MGSNRAS

SEQ ID NO: 2845 - protein, 7 aa, Artificial Sequence
  Made in Lab - CRDL2 from anti-Fzd VL chain
LGSNRAS

SEQ ID NO: 2846 - protein, 7 aa, Artificial Sequence
  Made in Lab - CRDL2 from anti-Fzd VL chain
GASSLHS

SEQ ID NO: 2847 - protein, 7 aa, Artificial Sequence
  Made in Lab - CRDL2 from anti-Fzd VL chain
KASTLQS

SEQ ID NO: 2848 - protein, 7 aa, Artificial Sequence
  Made in Lab - CRDL2 from anti-Fzd VL chain
LASNRAS

SEQ ID NO: 2849 - protein, 7 aa, Artificial Sequence
  Made in Lab - CRDL2 from anti-Fzd VL chain
AASTLHS

SEQ ID NO: 2850 - protein, 7 aa, Artificial Sequence
  Made in Lab - CRDL2 from anti-Fzd VL chain
AASSLQS

SEQ ID NO: 2851 - protein, 7 aa, Artificial Sequence
  Made in Lab - CRDL2 from anti-Fzd VL chain
LASNRAS

SEQ ID NO: 2852 - protein, 7 aa, Artificial Sequence
  Made in Lab - CRDL2 from anti-Fzd VL chain
AAAILQN

SEQ ID NO: 2853 - protein, 7 aa, Artificial Sequence
  Made in Lab - CRDL2 from anti-Fzd VL chain
GASNLQS

SEQ ID NO: 2854 - protein, 7 aa, Artificial Sequence
  Made in Lab - CRDL2 from anti-Fzd VL chain
AASRLQS

SEQ ID NO: 2855 - protein, 7 aa, Artificial Sequence
  Made in Lab - CRDL2 from anti-Fzd VL chain
GATTLMS

SEQ ID NO: 2856 - protein, 7 aa, Artificial Sequence
  Made in Lab - CRDL2 from anti-Fzd VL chain
GATTLMS

SEQ ID NO: 2857 - protein, 7 aa, Artificial Sequence
  Made in Lab - CRDL2 from anti-Fzd VL chain
AASSLQS

SEQ ID NO: 2858 - protein, 7 aa, Artificial Sequence
  Made in Lab - CRDL2 from anti-Fzd VL chain
AASSLZS

SEQ ID NO: 2859 - protein, 7 aa, Artificial Sequence
  Made in Lab - CRDL2 from anti-Fzd VL chain
KASSLER

SEQ ID NO: 2860 - protein, 7 aa, Artificial Sequence
  Made in Lab - CRDL2 from anti-Fzd VL chain
LGSNRAS

SEQ ID NO: 2861 - protein, 7 aa, Artificial Sequence
  Made in Lab - CRDL2 from anti-Fzd VL chain
GASTRAT

SEQ ID NO: 2862 - protein, 7 aa, Artificial Sequence
  Made in Lab - CRDL2 from anti-Fzd VL chain
DATNLAT

SEQ ID NO: 2863 - protein, 7 aa, Artificial Sequence
  Made in Lab - CRDL2 from anti-Fzd VL chain
AASSLQS

SEQ ID NO: 2864 - protein, 7 aa, Artificial Sequence
  Made in Lab - CRDL2 from anti-Fzd VL chain
AASSLQS

SEQ ID NO: 2865 - protein, 7 aa, Artificial Sequence
  Made in Lab - CRDL2 from anti-Fzd VL chain
GASTRAT

SEQ ID NO: 2866 - protein, 7 aa, Artificial Sequence
  Made in Lab - CRDL2 from anti-Fzd VL chain
GASTRAT

SEQ ID NO: 2867 - protein, 7 aa, Artificial Sequence
  Made in Lab - CRDL2 from anti-Fzd VL chain
GASTRAT

SEQ ID NO: 2868 - protein, 7 aa, Artificial Sequence
  Made in Lab - CRDL2 from anti-Fzd VL chain
LGSNRAS

SEQ ID NO: 2869 - protein, 7 aa, Artificial Sequence
  Made in Lab - CRDL2 from anti-Fzd VL chain
AASTLQS

SEQ ID NO: 2870 - protein, 7 aa, Artificial Sequence
  Made in Lab - CRDL2 from anti-Fzd VL chain
AASSLQS

SEQ ID NO: 2871 - protein, 7 aa, Artificial Sequence
  Made in Lab - CRDL2 from anti-Fzd VL chain
LGSNRAS

SEQ ID NO: 2872 - protein, 7 aa, Artificial Sequence
  Made in Lab - CRDL2 from anti-Fzd VL chain
KASSLEN

SEQ ID NO: 2873 - protein, 7 aa, Artificial Sequence
  Made in Lab - CRDL2 from anti-Fzd VL chain
LGSNRAS

SEQ ID NO: 2874 - protein, 7 aa, Artificial Sequence
  Made in Lab - CRDL2 from anti-Fzd VL chain
GASTRAT

SEQ ID NO: 2875 - protein, 7 aa, Artificial Sequence
  Made in Lab - CRDL2 from anti-Fzd VL chain
AASSLQS

SEQ ID NO: 2876 - protein, 7 aa, Artificial Sequence
  Made in Lab - CRDL2 from anti-Fzd VL chain
GASTRAT

SEQ ID NO: 2877 - protein, 7 aa, Artificial Sequence
  Made in Lab - CRDL2 from anti-Fzd VL chain
AASSLQS

SEQ ID NO: 2878 - protein, 7 aa, Artificial Sequence
  Made in Lab - CRDL2 from anti-Fzd VL chain
LGSNRAS

SEQ ID NO: 2879 - protein, 7 aa, Artificial Sequence
  Made in Lab - CRDL2 from anti-Fzd VL chain
ATSSLQS

SEQ ID NO: 2880 - protein, 7 aa, Artificial Sequence
  Made in Lab - CRDL2 from anti-Fzd VL chain
AASSLQS

SEQ ID NO: 2881 - protein, 7 aa, Artificial Sequence
  Made in Lab - CRDL2 from anti-Fzd VL chain
VASNWAS

SEQ ID NO: 2882 - protein, 7 aa, Artificial Sequence
  Made in Lab - CRDL2 from anti-Fzd VL chain
LGSNRAS

SEQ ID NO: 2883 - protein, 7 aa, Artificial Sequence
  Made in Lab - CRDL2 from anti-Fzd VL chain
AASTLQS

SEQ ID NO: 2884 - protein, 7 aa, Artificial Sequence
  Made in Lab - CRDL2 from anti-Fzd VL chain
AASSLQS

SEQ ID NO: 2885 - protein, 7 aa, Artificial Sequence
  Made in Lab - CRDL2 from anti-Fzd VL chain
LGSSRAS

SEQ ID NO: 2886 - protein, 7 aa, Artificial Sequence
  Made in Lab - CRDL2 from anti-Fzd VL chain
LGSNRAS

SEQ ID NO: 2887 - protein, 7 aa, Artificial Sequence
  Made in Lab - CRDL2 from anti-Fzd VL chain
LGSHRPS

SEQ ID NO: 2888 - protein, 7 aa, Artificial Sequence
  Made in Lab - CRDL2 from anti-Fzd VL chain
LGSHRAS

SEQ ID NO: 2889 - protein, 7 aa, Artificial Sequence
  Made in Lab - CRDL2 from anti-Fzd VL chain
AASSLQS

SEQ ID NO: 2890 - protein, 7 aa, Artificial Sequence
  Made in Lab - CRDL2 from anti-Fzd VL chain
LGSNRAS

SEQ ID NO: 2891 - protein, 7 aa, Artificial Sequence
  Made in Lab - CRDL2 from anti-Fzd VL chain
GASTRAT

SEQ ID NO: 2892 - protein, 7 aa, Artificial Sequence
  Made in Lab - CRDL2 from anti-Fzd VL chain
GSTNLQN

SEQ ID NO: 2893 - protein, 7 aa, Artificial Sequence
  Made in Lab - CRDL2 from anti-Fzd VL chain
LGSNRAS

SEQ ID NO: 2894 - protein, 7 aa, Artificial Sequence
  Made in Lab - CRDL2 from anti-Fzd VL chain
WASTRES

SEQ ID NO: 2895 - protein, 7 aa, Artificial Sequence
  Made in Lab - CRDL2 from anti-Fzd VL chain
AASSLQS

SEQ ID NO: 2896 - protein, 7 aa, Artificial Sequence
  Made in Lab - CRDL2 from anti-Fzd VL chain
GASTRAT

SEQ ID NO: 2897 - protein, 7 aa, Artificial Sequence
  Made in Lab - CRDL2 from anti-Fzd VL chain
LGSNRAS

SEQ ID NO: 2898 - protein, 7 aa, Artificial Sequence
  Made in Lab - CRDL2 from anti-Fzd VL chain
AASSLQS

SEQ ID NO: 2899 - protein, 7 aa, Artificial Sequence
  Made in Lab - CRDL2 from anti-Fzd VL chain
LGSNRAS

SEQ ID NO: 2900 - protein, 7 aa, Artificial Sequence
  Made in Lab - CRDL2 from anti-Fzd VL chain
AASTLQG

SEQ ID NO: 2901 - protein, 7 aa, Artificial Sequence
  Made in Lab - CRDL2 from anti-Fzd VL chain
GASTRAT

SEQ ID NO: 2902 - protein, 7 aa, Artificial Sequence
  Made in Lab - CRDL2 from anti-Fzd VL chain
KASSLES

SEQ ID NO: 2903 - protein, 7 aa, Artificial Sequence
  Made in Lab - CRDL2 from anti-Fzd VL chain
LSSNRAS

SEQ ID NO: 2904 - protein, 7 aa, Artificial Sequence
  Made in Lab - CRDL2 from anti-Fzd VL chain
YASQSIS

SEQ ID NO: 2905 - protein, 7 aa, Artificial Sequence
  Made in Lab - CRDL2 from anti-Fzd VL chain
ZASTRES

SEQ ID NO: 2906 - protein, 7 aa, Artificial Sequence
  Made in Lab - CRDL2 from anti-Fzd VL chain
DASNLET

SEQ ID NO: 2907 - protein, 7 aa, Artificial Sequence
  Made in Lab - CRDL2 from anti-Fzd VL chain
DASNLET

SEQ ID NO: 2908 - protein, 7 aa, Artificial Sequence
  Made in Lab - CRDL2 from anti-Fzd VL chain
AASZZQS

SEQ ID NO: 2909 - protein, 7 aa, Artificial Sequence
  Made in Lab - CRDL2 from anti-Fzd VL chain
AASSLQS

SEQ ID NO: 2910 - protein, 7 aa, Artificial Sequence
  Made in Lab - CRDL2 from anti-Fzd VL chain
AASSRAA

SEQ ID NO: 2911 - protein, 7 aa, Artificial Sequence
  Made in Lab - CRDL2 from anti-Fzd VL chain
LGSNRAS

SEQ ID NO: 2912 - protein, 7 aa, Artificial Sequence
  Made in Lab - CRDL2 from anti-Fzd VL chain
ATSSLHT

SEQ ID NO: 2913 - protein, 7 aa, Artificial Sequence
  Made in Lab - CRDL2 from anti-Fzd VL chain
WASTRES

SEQ ID NO: 2914 - protein, 7 aa, Artificial Sequence
  Made in Lab - CRDL2 from anti-Fzd VL chain
AASSLQS

SEQ ID NO: 2915 - protein, 7 aa, Artificial Sequence
  Made in Lab - CRDL2 from anti-Fzd VL chain
AASTLQS

SEQ ID NO: 2916 - protein, 7 aa, Artificial Sequence
  Made in Lab - CRDL2 from anti-Fzd VL chain
GASNLET

SEQ ID NO: 2917 - protein, 7 aa, Artificial Sequence
  Made in Lab - CRDL2 from anti-Fzd VL chain
AASSLQS

SEQ ID NO: 2918 - protein, 7 aa, Artificial Sequence
  Made in Lab - CRDL2 from anti-Fzd VL chain
WASTRES

SEQ ID NO: 2919 - protein, 7 aa, Artificial Sequence
  Made in Lab - CRDL2 from anti-Fzd VL chain
AASTLQS

SEQ ID NO: 2920 - protein, 7 aa, Artificial Sequence
  Made in Lab - CRDL2 from anti-Fzd VL chain
AASSLHS

SEQ ID NO: 2921 - protein, 7 aa, Artificial Sequence
  Made in Lab - CRDL2 from anti-Fzd VL chain
AASTLQS

SEQ ID NO: 2922 - protein, 7 aa, Artificial Sequence
  Made in Lab - CRDL2 from anti-Fzd VL chain
AASSLQS

SEQ ID NO: 2923 - protein, 7 aa, Artificial Sequence
  Made in Lab - CRDL2 from anti-Fzd VL chain
ASSRLQT

SEQ ID NO: 2924 - protein, 7 aa, Artificial Sequence
  Made in Lab - CRDL2 from anti-Fzd VL chain
AASSLQS

SEQ ID NO: 2925 - protein, 7 aa, Artificial Sequence
  Made in Lab - CRDL2 from anti-Fzd VL chain
DASNLET

SEQ ID NO: 2926 - protein, 7 aa, Artificial Sequence
  Made in Lab - CRDL2 from anti-Fzd VL chain
WASTRAY

SEQ ID NO: 2927 - protein, 7 aa, Artificial Sequence
  Made in Lab - CRDL2 from anti-Fzd VL chain
AASSLQS

SEQ ID NO: 2928 - protein, 7 aa, Artificial Sequence
  Made in Lab - CRDL2 from anti-Fzd VL chain
LGSNRAS

SEQ ID NO: 2929 - protein, 7 aa, Artificial Sequence
  Made in Lab - CRDL2 from anti-Fzd VL chain
LGSNRAS

SEQ ID NO: 2930 - protein, 7 aa, Artificial Sequence
  Made in Lab - CRDL2 from anti-Fzd VL chain
AASSLQS

SEQ ID NO: 2931 - protein, 7 aa, Artificial Sequence
  Made in Lab - CRDL2 from anti-Fzd VL chain
AASNLQS

SEQ ID NO: 2932 - protein, 7 aa, Artificial Sequence
  Made in Lab - CRDL2 from anti-Fzd VL chain
DATNLKT

SEQ ID NO: 2933 - protein, 7 aa, Artificial Sequence
  Made in Lab - CRDL2 from anti-Fzd VL chain
LGSNRAS

SEQ ID NO: 2934 - protein, 7 aa, Artificial Sequence
  Made in Lab - CRDL2 from anti-Fzd VL chain
WASTRQS

SEQ ID NO: 2935 - protein, 7 aa, Artificial Sequence
  Made in Lab - CRDL2 from anti-Fzd VL chain
GASSLQG

SEQ ID NO: 2936 - protein, 7 aa, Artificial Sequence
  Made in Lab - CRDL2 from anti-Fzd VL chain
KASSLES

SEQ ID NO: 2937 - protein, 7 aa, Artificial Sequence
  Made in Lab - CRDL2 from anti-Fzd VL chain
AASNLQS

SEQ ID NO: 2938 - protein, 7 aa, Artificial Sequence
  Made in Lab - CRDL2 from anti-Fzd VL chain
AASSLQS

SEQ ID NO: 2939 - protein, 7 aa, Artificial Sequence
  Made in Lab - CRDL2 from anti-Fzd VL chain
GASNLET

SEQ ID NO: 2940 - protein, 7 aa, Artificial Sequence
  Made in Lab - CRDL2 from anti-Fzd VL chain
AASTLQS

SEQ ID NO: 2941 - protein, 7 aa, Artificial Sequence
  Made in Lab - CRDL2 from anti-Fzd VL chain
LGSNRAS

SEQ ID NO: 2942 - protein, 7 aa, Artificial Sequence
  Made in Lab - CRDL2 from anti-Fzd VL chain
AASTLQS

SEQ ID NO: 2943 - protein, 7 aa, Artificial Sequence
  Made in Lab - CRDL2 from anti-Fzd VL chain
LGSNRAS

SEQ ID NO: 2944 - protein, 7 aa, Artificial Sequence
  Made in Lab - CRDL2 from anti-Fzd VL chain
KASTLGS

SEQ ID NO: 2945 - protein, 7 aa, Artificial Sequence
  Made in Lab - CRDL2 from anti-Fzd VL chain
LGSNRAS

SEQ ID NO: 2946 - protein, 7 aa, Artificial Sequence
  Made in Lab - CRDL2 from anti-Fzd VL chain
KASSLES

SEQ ID NO: 2947 - protein, 7 aa, Artificial Sequence
  Made in Lab - CRDL2 from anti-Fzd VL chain
AASSLQS

SEQ ID NO: 2948 - protein, 7 aa, Artificial Sequence
  Made in Lab - CRDL2 from anti-Fzd VL chain
DASNLET

SEQ ID NO: 2949 - protein, 7 aa, Artificial Sequence
  Made in Lab - CRDL2 from anti-Fzd VL chain
GASTRAT

SEQ ID NO: 2950 - protein, 7 aa, Artificial Sequence
  Made in Lab - CRDL2 from anti-Fzd VL chain
AASSLQS

SEQ ID NO: 2951 - protein, 7 aa, Artificial Sequence
  Made in Lab - CRDL2 from anti-Fzd VL chain
AASSLQS

SEQ ID NO: 2952 - protein, 7 aa, Artificial Sequence
  Made in Lab - CRDL2 from anti-Fzd VL chain
AASSLQS

SEQ ID NO: 2953 - protein, 7 aa, Artificial Sequence
  Made in Lab - CRDL2 from anti-Fzd VL chain
AASSLQS

SEQ ID NO: 2954 - protein, 7 aa, Artificial Sequence
  Made in Lab - CRDL2 from anti-Fzd VL chain
SASTLQS

SEQ ID NO: 2955 - protein, 7 aa, Artificial Sequence
  Made in Lab - CRDL2 from anti-Fzd VL chain
AASSLQS

SEQ ID NO: 2956 - protein, 7 aa, Artificial Sequence
  Made in Lab - CRDL2 from anti-Fzd VL chain
AASILQS

SEQ ID NO: 2957 - protein, 7 aa, Artificial Sequence
  Made in Lab - CRDL2 from anti-Fzd VL chain
QASTSQS

SEQ ID NO: 2958 - protein, 7 aa, Artificial Sequence
  Made in Lab - CRDL2 from anti-Fzd VL chain
GASTLQA

SEQ ID NO: 2959 - protein, 7 aa, Artificial Sequence
  Made in Lab - CRDL2 from anti-Fzd VL chain
WASTRES

SEQ ID NO: 2960 - protein, 7 aa, Artificial Sequence
  Made in Lab - CRDL2 from anti-Fzd VL chain
NASSLQS

SEQ ID NO: 2961 - protein, 7 aa, Artificial Sequence
  Made in Lab - CRDL2 from anti-Fzd VL chain
DASTLES

SEQ ID NO: 2962 - protein, 7 aa, Artificial Sequence
  Made in Lab - CRDL2 from anti-Fzd VL chain
AASSLQT

SEQ ID NO: 2963 - protein, 7 aa, Artificial Sequence
  Made in Lab - CRDL2 from anti-Fzd VL chain
AASSLQS

SEQ ID NO: 2964 - protein, 7 aa, Artificial Sequence
  Made in Lab - CRDL2 from anti-Fzd VL chain
DASNLET

SEQ ID NO: 2965 - protein, 7 aa, Artificial Sequence
  Made in Lab - CRDL2 from anti-Fzd VL chain
LGSNRAS

SEQ ID NO: 2966 - protein, 7 aa, Artificial Sequence
  Made in Lab - CRDL2 from anti-Fzd VL chain
AASSLQS

SEQ ID NO: 2967 - protein, 7 aa, Artificial Sequence
  Made in Lab - CRDL2 from anti-Fzd VL chain
LGSNRAS

SEQ ID NO: 2968 - protein, 7 aa, Artificial Sequence
  Made in Lab - CRDL2 from anti-Fzd VL chain
KASSLES

SEQ ID NO: 2969 - protein, 7 aa, Artificial Sequence
  Made in Lab - CRDL2 from anti-Fzd VL chain
KASSLES

SEQ ID NO: 2970 - protein, 7 aa, Artificial Sequence
  Made in Lab - CRDL2 from anti-Fzd VL chain
GASTRAT

SEQ ID NO: 2971 - protein, 7 aa, Artificial Sequence
  Made in Lab - CRDL2 from anti-Fzd VL chain
AASSLQS

SEQ ID NO: 2972 - protein, 7 aa, Artificial Sequence
  Made in Lab - CRDL2 from anti-Fzd VL chain
AASNLET

SEQ ID NO: 2973 - protein, 7 aa, Artificial Sequence
  Made in Lab - CRDL2 from anti-Fzd VL chain
LGSNRAS

SEQ ID NO: 2974 - protein, 7 aa, Artificial Sequence
  Made in Lab - CRDL2 from anti-Fzd VL chain
TASTLQS

SEQ ID NO: 2975 - protein, 7 aa, Artificial Sequence
  Made in Lab - CRDL2 from anti-Fzd VL chain
TASNLQT

SEQ ID NO: 2976 - protein, 7 aa, Artificial Sequence
  Made in Lab - CRDL2 from anti-Fzd VL chain
AASHLQS

SEQ ID NO: 2977 - protein, 7 aa, Artificial Sequence
  Made in Lab - CRDL2 from anti-Fzd VL chain
LGSSRAS

SEQ ID NO: 2978 - protein, 7 aa, Artificial Sequence
  Made in Lab - CRDL2 from anti-Fzd VL chain
QASTLER

SEQ ID NO: 2979 - protein, 7 aa, Artificial Sequence
  Made in Lab - CRDL2 from anti-Fzd VL chain
AASTLQS

SEQ ID NO: 2980 - protein, 7 aa, Artificial Sequence
  Made in Lab - CRDL2 from anti-Fzd VL chain
AASTLQS

SEQ ID NO: 2981 - protein, 7 aa, Artificial Sequence
  Made in Lab - CRDL2 from anti-Fzd VL chain
TASTLQS

SEQ ID NO: 2982 - protein, 7 aa, Artificial Sequence
  Made in Lab - CRDL2 from anti-Fzd VL chain
WASTRES

SEQ ID NO: 2983 - protein, 7 aa, Artificial Sequence
  Made in Lab - CRDL2 from anti-Fzd VL chain
RASSLQS

SEQ ID NO: 2984 - protein, 7 aa, Artificial Sequence
  Made in Lab - CRDL2 from anti-Fzd VL chain
AASTLQS

SEQ ID NO: 2985 - protein, 7 aa, Artificial Sequence
  Made in Lab - CRDL2 from anti-Fzd VL chain
DASNLQT

SEQ ID NO: 2986 - protein, 7 aa, Artificial Sequence
  Made in Lab - CRDL2 from anti-Fzd VL chain
AASSLQS

SEQ ID NO: 2987 - protein, 7 aa, Artificial Sequence
  Made in Lab - CRDL2 from anti-Fzd VL chain
AASTLRS

SEQ ID NO: 2988 - protein, 7 aa, Artificial Sequence
  Made in Lab - CRDL2 from anti-Fzd VL chain
TASSLQS

SEQ ID NO: 2989 - protein, 7 aa, Artificial Sequence
  Made in Lab - CRDL2 from anti-Fzd VL chain
WASTRAS

SEQ ID NO: 2990 - protein, 7 aa, Artificial Sequence
  Made in Lab - CRDL2 from anti-Fzd VL chain
SGSSRAS

SEQ ID NO: 2991 - protein, 7 aa, Artificial Sequence
  Made in Lab - CRDL2 from anti-Fzd VL chain
DASKLQS

SEQ ID NO: 2992 - protein, 7 aa, Artificial Sequence
  Made in Lab - CRDL2 from anti-Fzd VL chain
AASSLQS

SEQ ID NO: 2993 - protein, 7 aa, Artificial Sequence
  Made in Lab - CRDL2 from anti-Fzd VL chain
LGSNRAS

SEQ ID NO: 2994 - protein, 7 aa, Artificial Sequence
  Made in Lab - CRDL2 from anti-Fzd VL chain
GASSLQS

SEQ ID NO: 2995 - protein, 7 aa, Artificial Sequence
  Made in Lab - CRDL2 from anti-Fzd VL chain
AASSLHT

SEQ ID NO: 2996 - protein, 7 aa, Artificial Sequence
  Made in Lab - CRDL2 from anti-Fzd VL chain
SASNLQS

SEQ ID NO: 2997 - protein, 7 aa, Artificial Sequence
  Made in Lab - CRDL2 from anti-Fzd VL chain
AASTLQS

SEQ ID NO: 2998 - protein, 7 aa, Artificial Sequence
  Made in Lab - CRDL2 from anti-Fzd VL chain
AASTLQS

SEQ ID NO: 2999 - protein, 7 aa, Artificial Sequence
  Made in Lab - CRDL2 from anti-Fzd VL chain
LGSYRAS

SEQ ID NO: 3000 - protein, 7 aa, Artificial Sequence
  Made in Lab - CRDL2 from anti-Fzd VL chain
WASTRES

SEQ ID NO: 3001 - protein, 7 aa, Artificial Sequence
  Made in Lab - CRDL2 from anti-Fzd VL chain
WASTRES

SEQ ID NO: 3002 - protein, 7 aa, Artificial Sequence
  Made in Lab - CRDL2 from anti-Fzd VL chain
KASSLES

SEQ ID NO: 3003 - protein, 7 aa, Artificial Sequence
  Made in Lab - CRDL2 from anti-Fzd VL chain
AASTLQS

SEQ ID NO: 3004 - protein, 7 aa, Artificial Sequence
  Made in Lab - CRDL2 from anti-Fzd VL chain
LGSNRAS

SEQ ID NO: 3005 - protein, 7 aa, Artificial Sequence
  Made in Lab - CRDL2 from anti-Fzd VL chain
AASSLQS

SEQ ID NO: 3006 - protein, 7 aa, Artificial Sequence
  Made in Lab - CRDL2 from anti-Fzd VL chain
KASSLES

SEQ ID NO: 3007 - protein, 7 aa, Artificial Sequence
  Made in Lab - CRDL2 from anti-Fzd VL chain
AASALQS

SEQ ID NO: 3008 - protein, 7 aa, Artificial Sequence
  Made in Lab - CRDL2 from anti-Fzd VL chain
KASSLES

SEQ ID NO: 3009 - protein, 7 aa, Artificial Sequence
  Made in Lab - CRDL2 from anti-Fzd VL chain
LGSNRAS

SEQ ID NO: 3010 - protein, 7 aa, Artificial Sequence
  Made in Lab - CRDL2 from anti-Fzd VL chain
DASNLET

SEQ ID NO: 3011 - protein, 7 aa, Artificial Sequence
  Made in Lab - CRDL2 from anti-Fzd VL chain
LGSNRAS

SEQ ID NO: 3012 - protein, 7 aa, Artificial Sequence
  Made in Lab - CRDL2 from anti-Fzd VL chain
AASSLQS

SEQ ID NO: 3013 - protein, 7 aa, Artificial Sequence
  Made in Lab - CRDL2 from anti-Fzd VL chain
ATSSRAA

SEQ ID NO: 3014 - protein, 7 aa, Artificial Sequence
  Made in Lab - CRDL2 from anti-Fzd VL chain
AASILQR

SEQ ID NO: 3015 - protein, 7 aa, Artificial Sequence
  Made in Lab - CRDL2 from anti-Fzd VL chain
KASTLES

SEQ ID NO: 3016 - protein, 7 aa, Artificial Sequence
  Made in Lab - CRDL2 from anti-Fzd VL chain
LGSNRAS

SEQ ID NO: 3017 - protein, 7 aa, Artificial Sequence
  Made in Lab - CRDL2 from anti-Fzd VL chain
AASSLQS

SEQ ID NO: 3018 - protein, 7 aa, Artificial Sequence
  Made in Lab - CRDL2 from anti-Fzd VL chain
DASNLET

SEQ ID NO: 3019 - protein, 7 aa, Artificial Sequence
  Made in Lab - CRDL2 from anti-Fzd VL chain
AASSLQS

SEQ ID NO: 3020 - protein, 7 aa, Artificial Sequence
  Made in Lab - CRDL2 from anti-Fzd VL chain
GASTLQS

SEQ ID NO: 3021 - protein, 7 aa, Artificial Sequence
  Made in Lab - CRDL2 from anti-Fzd VL chain
RASSLQG

SEQ ID NO: 3022 - protein, 7 aa, Artificial Sequence
  Made in Lab - CRDL2 from anti-Fzd VL chain
LGSYRAS

SEQ ID NO: 3023 - protein, 7 aa, Artificial Sequence
  Made in Lab - CRDL2 from anti-Fzd VL chain
AASSLQS

SEQ ID NO: 3024 - protein, 7 aa, Artificial Sequence
  Made in Lab - CRDL2 from anti-Fzd VL chain
GASTRAT

SEQ ID NO: 3025 - protein, 7 aa, Artificial Sequence
  Made in Lab - CRDL2 from anti-Fzd VL chain
LGSHRAS

SEQ ID NO: 3026 - protein, 7 aa, Artificial Sequence
  Made in Lab - CRDL2 from anti-Fzd VL chain
AASSLQS

SEQ ID NO: 3027 - protein, 7 aa, Artificial Sequence
  Made in Lab - CRDL2 from anti-Fzd VL chain
AASSLQS

SEQ ID NO: 3028 - protein, 7 aa, Artificial Sequence
  Made in Lab - CRDL2 from anti-Fzd VL chain
GSSRLPS

SEQ ID NO: 3029 - protein, 7 aa, Artificial Sequence
  Made in Lab - CRDL2 from anti-Fzd VL chain
LGSNRAS

SEQ ID NO: 3030 - protein, 7 aa, Artificial Sequence
  Made in Lab - CRDL2 from anti-Fzd VL chain
LGSNRAS

SEQ ID NO: 3031 - protein, 7 aa, Artificial Sequence
  Made in Lab - CRDL2 from anti-Fzd VL chain
LGSNRAS

SEQ ID NO: 3032 - protein, 7 aa, Artificial Sequence
  Made in Lab - CRDL2 from anti-Fzd VL chain
TASTLQT

SEQ ID NO: 3033 - protein, 7 aa, Artificial Sequence
  Made in Lab - CRDL2 from anti-Fzd VL chain
VASNLES

SEQ ID NO: 3034 - protein, 7 aa, Artificial Sequence
  Made in Lab - CRDL2 from anti-Fzd VL chain
GASVLQS

SEQ ID NO: 3035 - protein, 7 aa, Artificial Sequence
  Made in Lab - CRDL2 from anti-Fzd VL chain
DASSLQG

SEQ ID NO: 3036 - protein, 7 aa, Artificial Sequence
  Made in Lab - CRDL2 from anti-Fzd VL chain
AASNLQA

SEQ ID NO: 3037 - protein, 7 aa, Artificial Sequence
  Made in Lab - CRDL2 from anti-Fzd VL chain
AASTLQS

SEQ ID NO: 3038 - protein, 7 aa, Artificial Sequence
  Made in Lab - CRDL2 from anti-Fzd VL chain
AASNWQS

SEQ ID NO: 3039 - protein, 7 aa, Artificial Sequence
  Made in Lab - CRDL2 from anti-Fzd VL chain
AASSLQS

SEQ ID NO: 3040 - protein, 7 aa, Artificial Sequence
  Made in Lab - CRDL2 from anti-Fzd VL chain
AASSLQS

SEQ ID NO: 3041 - protein, 7 aa, Artificial Sequence
  Made in Lab - CRDL2 from anti-Fzd VL chain
LGSNRAS

SEQ ID NO: 3042 - protein, 7 aa, Artificial Sequence
  Made in Lab - CRDL2 from anti-Fzd VL chain
SASNLET

SEQ ID NO: 3043 - protein, 7 aa, Artificial Sequence
  Made in Lab - CRDL2 from anti-Fzd VL chain
AASTLQT

SEQ ID NO: 3044 - protein, 7 aa, Artificial Sequence
  Made in Lab - CRDL2 from anti-Fzd VL chain
AASSLQS

SEQ ID NO: 3045 - protein, 7 aa, Artificial Sequence
  Made in Lab - CRDL2 from anti-Fzd VL chain
TASTLZS

SEQ ID NO: 3046 - protein, 7 aa, Artificial Sequence
  Made in Lab - CRDL2 from anti-Fzd VL chain
GASNLET

SEQ ID NO: 3047 - protein, 13 aa, Artificial Sequence
  Made in Lab - CRDL2 from anti-Fzd VL chain
GWZNPNGGNTZYA

SEQ ID NO: 3048 - protein, 7 aa, Artificial Sequence
  Made in Lab - CRDL2 from anti-Fzd VL chain
AASSLQS

SEQ ID NO: 3049 - protein, 7 aa, Artificial Sequence
  Made in Lab - CRDL2 from anti-Fzd VL chain
AASTLQS

SEQ ID NO: 3050 - protein, 7 aa, Artificial Sequence
  Made in Lab - CRDL2 from anti-Fzd VL chain
AASSLQS

SEQ ID NO: 3051 - protein, 7 aa, Artificial Sequence
  Made in Lab - CRDL2 from anti-Fzd VL chain
LGSNRAS

SEQ ID NO: 3052 - protein, 7 aa, Artificial Sequence
  Made in Lab - CRDL2 from anti-Fzd VL chain
ZZSTRES

SEQ ID NO: 3053 - protein, 7 aa, Artificial Sequence
  Made in Lab - CRDL2 from anti-Fzd VL chain
AASNLQS

SEQ ID NO: 3054 - protein, 7 aa, Artificial Sequence
  Made in Lab - CRDL2 from anti-Fzd VL chain
RASILQS

SEQ ID NO: 3055 - protein, 7 aa, Artificial Sequence
  Made in Lab - CRDL2 from anti-Fzd VL chain
LGSNRAS

SEQ ID NO: 3056 - protein, 7 aa, Artificial Sequence
  Made in Lab - CRDL2 from anti-Fzd VL chain
AASSLQS

SEQ ID NO: 3057 - protein, 7 aa, Artificial Sequence
  Made in Lab - CRDL2 from anti-Fzd VL chain
LGTNRAS

SEQ ID NO: 3058 - protein, 7 aa, Artificial Sequence
  Made in Lab - CRDL2 from anti-Fzd VL chain
AASSLQS

SEQ ID NO: 3059 - protein, 7 aa, Artificial Sequence
  Made in Lab - CRDL2 from anti-Fzd VL chain
SASZLQS

SEQ ID NO: 3060 - protein, 7 aa, Artificial Sequence
  Made in Lab - CRDL2 from anti-Fzd VL chain
LASNRAS

SEQ ID NO: 3061 - protein, 7 aa, Artificial Sequence
  Made in Lab - CRDL2 from anti-Fzd VL chain
AASSLQS

SEQ ID NO: 3062 - protein, 7 aa, Artificial Sequence
  Made in Lab - CRDL2 from anti-Fzd VL chain
AASSLQS

SEQ ID NO: 3063 - protein, 7 aa, Artificial Sequence
  Made in Lab - CRDL2 from anti-Fzd VL chain
AASSLQS

SEQ ID NO: 3064 - protein, 7 aa, Artificial Sequence
  Made in Lab - CRDL2 from anti-Fzd VL chain
LGSNRAS

SEQ ID NO: 3065 - protein, 7 aa, Artificial Sequence
  Made in Lab - CRDL2 from anti-Fzd VL chain
KASSLGS

SEQ ID NO: 3066 - protein, 7 aa, Artificial Sequence
  Made in Lab - CRDL2 from anti-Fzd VL chain
AASSLQS

SEQ ID NO: 3067 - protein, 7 aa, Artificial Sequence
  Made in Lab - CRDL2 from anti-Fzd VL chain
LGSNRAS

SEQ ID NO: 3068 - protein, 7 aa, Artificial Sequence
  Made in Lab - CRDL2 from anti-Fzd VL chain
LGSNRAS

SEQ ID NO: 3069 - protein, 7 aa, Artificial Sequence
  Made in Lab - CRDL2 from anti-Fzd VL chain
AASSLQS

SEQ ID NO: 3070 - protein, 7 aa, Artificial Sequence
  Made in Lab - CRDL2 from anti-Fzd VL chain
AASSLQS

SEQ ID NO: 3071 - protein, 7 aa, Artificial Sequence
  Made in Lab - CRDL2 from anti-Fzd VL chain
GASSLQR

SEQ ID NO: 3072 - protein, 7 aa, Artificial Sequence
  Made in Lab - CRDL2 from anti-Fzd VL chain
LGSNRAS

SEQ ID NO: 3073 - protein, 7 aa, Artificial Sequence
  Made in Lab - CRDL2 from anti-Fzd VL chain
LGSNRAS

SEQ ID NO: 3074 - protein, 7 aa, Artificial Sequence
  Made in Lab - CRDL2 from anti-Fzd VL chain
  misc_feature (1)..(1): Xaa can be any naturally occurring amino acid
XGSNRAS

SEQ ID NO: 3075 - protein, 7 aa, Artificial Sequence
  Made in Lab - CRDL2 from anti-Fzd VL chain
KISNRFS

SEQ ID NO: 3076 - protein, 7 aa, Artificial Sequence
  Made in Lab - CRDL2 from anti-Fzd VL chain
LGSNRAS

SEQ ID NO: 3077 - protein, 7 aa, Artificial Sequence
  Made in Lab - CRDL2 from anti-Fzd VL chain
AASSLQS

SEQ ID NO: 3078 - protein, 7 aa, Artificial Sequence
  Made in Lab - CRDL2 from anti-Fzd VL chain
WASTRES

SEQ ID NO: 3079 - protein, 7 aa, Artificial Sequence
  Made in Lab - CRDL2 from anti-Fzd VL chain
LGSNRAS

SEQ ID NO: 3080 - protein, 7 aa, Artificial Sequence
  Made in Lab - CRDL2 from anti-Fzd VL chain
LZSHRAS

SEQ ID NO: 3081 - protein, 7 aa, Artificial Sequence
  Made in Lab - CRDL2 from anti-Fzd VL chain
LGSNRAS

SEQ ID NO: 3082 - protein, 7 aa, Artificial Sequence
  Made in Lab - CRDL2 from anti-Fzd VL chain
AASSLQS

SEQ ID NO: 3083 - protein, 7 aa, Artificial Sequence
  Made in Lab - CRDL2 from anti-Fzd VL chain
LGSNRAS

SEQ ID NO: 3084 - protein, 7 aa, Artificial Sequence
  Made in Lab - CRDL2 from anti-Fzd VL chain
LGSHRAS

SEQ ID NO: 3085 - protein, 7 aa, Artificial Sequence
  Made in Lab - CRDL2 from anti-Fzd VL chain
AASSLQS

SEQ ID NO: 3086 - protein, 7 aa, Artificial Sequence
  Made in Lab - CRDL2 from anti-Fzd VL chain
LGSNRAS

SEQ ID NO: 3087 - protein, 7 aa, Artificial Sequence
  Made in Lab - CRDL2 from anti-Fzd VL chain
AASNLQS

SEQ ID NO: 3088 - protein, 7 aa, Artificial Sequence
  Made in Lab - CRDL2 from anti-Fzd VL chain
LASHRAS

SEQ ID NO: 3089 - protein, 11 aa, Artificial Sequence
  Made in Lab - CRDL2 from anti-Fzd VL chain
DKSDSDNHKGS

SEQ ID NO: 3090 - protein, 7 aa, Artificial Sequence
  Made in Lab - CRDL2 from anti-Fzd VL chain
KASNLEN

SEQ ID NO: 3091 - protein, 7 aa, Artificial Sequence
  Made in Lab - CRDL2 from anti-Fzd VL chain
GASTRYS

SEQ ID NO: 3092 - protein, 7 aa, Artificial Sequence
  Made in Lab - CRDL2 from anti-Fzd VL chain
GASSLQS

SEQ ID NO: 3093 - protein, 7 aa, Artificial Sequence
  Made in Lab - CRDL2 from anti-Fzd VL chain
LGSDRAS

SEQ ID NO: 3094 - protein, 7 aa, Artificial Sequence
  Made in Lab - CRDL2 from anti-Fzd VL chain
AASSLQS

SEQ ID NO: 3095 - protein, 7 aa, Artificial Sequence
  Made in Lab - CRDL2 from anti-Fzd VL chain
AASNWQS

SEQ ID NO: 3096 - protein, 7 aa, Artificial Sequence
  Made in Lab - CRDL2 from anti-Fzd VL chain
LGSNRAS

SEQ ID NO: 3097 - protein, 7 aa, Artificial Sequence
  Made in Lab - CRDL2 from anti-Fzd VL chain
LGSNRAS

SEQ ID NO: 3098 - protein, 7 aa, Artificial Sequence
  Made in Lab - CRDL2 from anti-Fzd VL chain
LGSDRAS

SEQ ID NO: 3099 - protein, 7 aa, Artificial Sequence
  Made in Lab - CRDL2 from anti-Fzd VL chain
LAZDRAS

SEQ ID NO: 3100 - protein, 7 aa, Artificial Sequence
  Made in Lab - CRDL2 from anti-Fzd VL chain
LGSNRAS

SEQ ID NO: 3101 - protein, 7 aa, Artificial Sequence
  Made in Lab - CRDL2 from anti-Fzd VL chain
DASYLQS

SEQ ID NO: 3102 - protein, 7 aa, Artificial Sequence
  Made in Lab - CRDL2 from anti-Fzd VL chain
GASSLQS

SEQ ID NO: 3103 - protein, 7 aa, Artificial Sequence
  Made in Lab - CRDL2 from anti-Fzd VL chain
DGSNLET

SEQ ID NO: 3104 - protein, 7 aa, Artificial Sequence
  Made in Lab - CRDL2 from anti-Fzd VL chain
DASNLET

SEQ ID NO: 3105 - protein, 7 aa, Artificial Sequence
  Made in Lab - CRDL2 from anti-Fzd VL chain
DASNLET

SEQ ID NO: 3106 - protein, 7 aa, Artificial Sequence
  Made in Lab - CRDL2 from anti-Fzd VL chain
AASNLQS

SEQ ID NO: 3107 - protein, 7 aa, Artificial Sequence
  Made in Lab - CRDL2 from anti-Fzd VL chain
LGSNRAS

SEQ ID NO: 3108 - protein, 7 aa, Artificial Sequence
  Made in Lab - CRDL2 from anti-Fzd VL chain
AASTLQS

SEQ ID NO: 3109 - protein, 7 aa, Artificial Sequence
  Made in Lab - CRDL2 from anti-Fzd VL chain
AASSLQS

SEQ ID NO: 3110 - protein, 7 aa, Artificial Sequence
  Made in Lab - CRDL2 from anti-Fzd VL chain
DASNLET

SEQ ID NO: 3111 - protein, 7 aa, Artificial Sequence
  Made in Lab - CRDL2 from anti-Fzd VL chain
AASTLQS

SEQ ID NO: 3112 - protein, 7 aa, Artificial Sequence
  Made in Lab - CRDL2 from anti-Fzd VL chain
AASSLQS

SEQ ID NO: 3113 - protein, 7 aa, Artificial Sequence
  Made in Lab - CRDL2 from anti-Fzd VL chain
AASSLQS

SEQ ID NO: 3114 - protein, 7 aa, Artificial Sequence
  Made in Lab - CRDL2 from anti-Fzd VL chain
YASSLQS

SEQ ID NO: 3115 - protein, 7 aa, Artificial Sequence
  Made in Lab - CRDL2 from anti-Fzd VL chain
AASSLQS

SEQ ID NO: 3116 - protein, 7 aa, Artificial Sequence
  Made in Lab - CRDL2 from anti-Fzd VL chain
STNTRSS

SEQ ID NO: 3117 - protein, 7 aa, Artificial Sequence
  Made in Lab - CRDL2 from anti-Fzd VL chain
AASNLQS

SEQ ID NO: 3118 - protein, 7 aa, Artificial Sequence
  Made in Lab - CRDL2 from anti-Fzd VL chain
GASNLQR

SEQ ID NO: 3119 - protein, 7 aa, Artificial Sequence
  Made in Lab - CRDL2 from anti-Fzd VL chain
AASSLQS

SEQ ID NO: 3120 - protein, 7 aa, Artificial Sequence
  Made in Lab - CRDL2 from anti-Fzd VL chain
WASTRKS

SEQ ID NO: 3121 - protein, 7 aa, Artificial Sequence
  Made in Lab - CRDL2 from anti-Fzd VL chain
GASTRAT

SEQ ID NO: 3122 - protein, 7 aa, Artificial Sequence
  Made in Lab - CRDL2 from anti-Fzd VL chain
GASTRAT

SEQ ID NO: 3123 - protein, 7 aa, Artificial Sequence
  Made in Lab - CRDL2 from anti-Fzd VL chain
GAYTLHS

SEQ ID NO: 3124 - protein, 7 aa, Artificial Sequence
  Made in Lab - CRDL2 from anti-Fzd VL chain
GASSLQS

SEQ ID NO: 3125 - protein, 7 aa, Artificial Sequence
  Made in Lab - CRDL2 from anti-Fzd VL chain
AASTLQD

SEQ ID NO: 3126 - protein, 7 aa, Artificial Sequence
  Made in Lab - CRDL2 from anti-Fzd VL chain
WASDRES

SEQ ID NO: 3127 - protein, 7 aa, Artificial Sequence
  Made in Lab - CRDL2 from anti-Fzd VL chain
DASRLER

SEQ ID NO: 3128 - protein, 7 aa, Artificial Sequence
  Made in Lab - CRDL2 from anti-Fzd VL chain
AASSLQS

SEQ ID NO: 3129 - protein, 7 aa, Artificial Sequence
  Made in Lab - CRDL2 from anti-Fzd VL chain
AASILQS

SEQ ID NO: 3130 - protein, 7 aa, Artificial Sequence
  Made in Lab - CRDL2 from anti-Fzd VL chain
DASNLET

SEQ ID NO: 3131 - protein, 7 aa, Artificial Sequence
  Made in Lab - CRDL2 from anti-Fzd VL chain
GASTRAT

SEQ ID NO: 3132 - protein, 7 aa, Artificial Sequence
  Made in Lab - CRDL2 from anti-Fzd VL chain
AASSLQS

SEQ ID NO: 3133 - protein, 7 aa, Artificial Sequence
  Made in Lab - CRDL2 from anti-Fzd VL chain
AASSLHS

SEQ ID NO: 3134 - protein, 7 aa, Artificial Sequence
  Made in Lab - CRDL2 from anti-Fzd VL chain
AASSLQS

SEQ ID NO: 3135 - protein, 7 aa, Artificial Sequence
  Made in Lab - CRDL2 from anti-Fzd VL chain
WASTRES

SEQ ID NO: 3136 - protein, 7 aa, Artificial Sequence
  Made in Lab - CRDL2 from anti-Fzd VL chain
AASSLQS

SEQ ID NO: 3137 - protein, 7 aa, Artificial Sequence
  Made in Lab - CRDL2 from anti-Fzd VL chain
AASTLQS

SEQ ID NO: 3138 - protein, 7 aa, Artificial Sequence
  Made in Lab - CRDL2 from anti-Fzd VL chain
AASSLQS

SEQ ID NO: 3139 - protein, 7 aa, Artificial Sequence
  Made in Lab - CRDL2 from anti-Fzd VL chain
KASTLES

SEQ ID NO: 3140 - protein, 7 aa, Artificial Sequence
  Made in Lab - CRDL2 from anti-Fzd VL chain
GASTLQS

SEQ ID NO: 3141 - protein, 7 aa, Artificial Sequence
  Made in Lab - CRDL2 from anti-Fzd VL chain
WASTRES

SEQ ID NO: 3142 - protein, 7 aa, Artificial Sequence
  Made in Lab - CRDL2 from anti-Fzd VL chain
ATSSLHG

SEQ ID NO: 3143 - protein, 7 aa, Artificial Sequence
  Made in Lab - CRDL2 from anti-Fzd VL chain
AASSLRS

SEQ ID NO: 3144 - protein, 7 aa, Artificial Sequence
  Made in Lab - CRDL2 from anti-Fzd VL chain
AASSLQS

SEQ ID NO: 3145 - protein, 7 aa, Artificial Sequence
  Made in Lab - CRDL2 from anti-Fzd VL chain
AASSLQS

SEQ ID NO: 3146 - protein, 7 aa, Artificial Sequence
  Made in Lab - CRDL2 from anti-Fzd VL chain
WASTRES

SEQ ID NO: 3147 - protein, 7 aa, Artificial Sequence
  Made in Lab - CRDL2 from anti-Fzd VL chain
KASSLES

SEQ ID NO: 3148 - protein, 7 aa, Artificial Sequence
  Made in Lab - CRDL2 from anti-Fzd VL chain
GASTRAT

SEQ ID NO: 3149 - protein, 7 aa, Artificial Sequence
  Made in Lab - CRDL2 from anti-Fzd VL chain
LGSNRAS

SEQ ID NO: 3150 - protein, 7 aa, Artificial Sequence
  Made in Lab - CRDL2 from anti-Fzd VL chain
AASILEN

SEQ ID NO: 3151 - protein, 7 aa, Artificial Sequence
  Made in Lab - CRDL2 from anti-Fzd VL chain
AASSLQS

SEQ ID NO: 3152 - protein, 7 aa, Artificial Sequence
  Made in Lab - CRDL2 from anti-Fzd VL chain
AASTLQS

SEQ ID NO: 3153 - protein, 7 aa, Artificial Sequence
  Made in Lab - CRDL2 from anti-Fzd VL chain
AASSLQS

SEQ ID NO: 3154 - protein, 7 aa, Artificial Sequence
  Made in Lab - CRDL2 from anti-Fzd VL chain
KASSLES

SEQ ID NO: 3155 - protein, 7 aa, Artificial Sequence
  Made in Lab - CRDL2 from anti-Fzd VL chain
TASSLRS

SEQ ID NO: 3156 - protein, 7 aa, Artificial Sequence
  Made in Lab - CRDL2 from anti-Fzd VL chain
ASSTLQS

SEQ ID NO: 3157 - protein, 7 aa, Artificial Sequence
  Made in Lab - CRDL2 from anti-Fzd VL chain
WASTRES

SEQ ID NO: 3158 - protein, 7 aa, Artificial Sequence
  Made in Lab - CRDL2 from anti-Fzd VL chain
LGSNRAS

SEQ ID NO: 3159 - protein, 7 aa, Artificial Sequence
  Made in Lab - CRDL2 from anti-Fzd VL chain
GASTLQS

SEQ ID NO: 3160 - protein, 7 aa, Artificial Sequence
  Made in Lab - CRDL2 from anti-Fzd VL chain
ATSSLQS

SEQ ID NO: 3161 - protein, 7 aa, Artificial Sequence
  Made in Lab - CRDL2 from anti-Fzd VL chain
AASSLQS

SEQ ID NO: 3162 - protein, 7 aa, Artificial Sequence
  Made in Lab - CRDL2 from anti-Fzd VL chain
AASTLQS

SEQ ID NO: 3163 - protein, 7 aa, Artificial Sequence
  Made in Lab - CRDL2 from anti-Fzd VL chain
DASTLQS

SEQ ID NO: 3164 - protein, 7 aa, Artificial Sequence
  Made in Lab - CRDL2 from anti-Fzd VL chain
LGSSRAS

SEQ ID NO: 3165 - protein, 7 aa, Artificial Sequence
  Made in Lab - CRDL2 from anti-Fzd VL chain
AASSLQS

SEQ ID NO: 3166 - protein, 7 aa, Artificial Sequence
  Made in Lab - CRDL2 from anti-Fzd VL chain
GTSNLET

SEQ ID NO: 3167 - protein, 7 aa, Artificial Sequence
  Made in Lab - CRDL2 from anti-Fzd VL chain
AASNLQS

SEQ ID NO: 3168 - protein, 7 aa, Artificial Sequence
  Made in Lab - CRDL2 from anti-Fzd VL chain
RASSLQR

SEQ ID NO: 3169 - protein, 7 aa, Artificial Sequence
  Made in Lab - CRDL2 from anti-Fzd VL chain
AASSLQS

SEQ ID NO: 3170 - protein, 7 aa, Artificial Sequence
  Made in Lab - CRDL2 from anti-Fzd VL chain
DAKDLHP

SEQ ID NO: 3171 - protein, 7 aa, Artificial Sequence
  Made in Lab - CRDL2 from anti-Fzd VL chain
AASRLQS

SEQ ID NO: 3172 - protein, 7 aa, Artificial Sequence
  Made in Lab - CRDL2 from anti-Fzd VL chain
AASNLQS

SEQ ID NO: 3173 - protein, 7 aa, Artificial Sequence
  Made in Lab - CRDL2 from anti-Fzd VL chain
DASNLET

SEQ ID NO: 3174 - protein, 7 aa, Artificial Sequence
  Made in Lab - CRDL2 from anti-Fzd VL chain
AASSLQS

SEQ ID NO: 3175 - protein, 7 aa, Artificial Sequence
  Made in Lab - CRDL2 from anti-Fzd VL chain
ATSARAT

SEQ ID NO: 3176 - protein, 7 aa, Artificial Sequence
  Made in Lab - CRDL2 from anti-Fzd VL chain
GASTRAT

SEQ ID NO: 3177 - protein, 7 aa, Artificial Sequence
  Made in Lab - CRDL2 from anti-Fzd VL chain
GASTRAT

SEQ ID NO: 3178 - protein, 7 aa, Artificial Sequence
  Made in Lab - CRDL2 from anti-Fzd VL chain
GASTRAT

SEQ ID NO: 3179 - protein, 7 aa, Artificial Sequence
  Made in Lab - CRDL2 from anti-Fzd VL chain
AASNLQS

SEQ ID NO: 3180 - protein, 7 aa, Artificial Sequence
  Made in Lab - CRDL2 from anti-Fzd VL chain
DATNLPT

SEQ ID NO: 3181 - protein, 7 aa, Artificial Sequence
  Made in Lab - CRDL2 from anti-Fzd VL chain
DASHLET

SEQ ID NO: 3182 - protein, 7 aa, Artificial Sequence
  Made in Lab - CRDL2 from anti-Fzd VL chain
LGSNRAS

SEQ ID NO: 3183 - protein, 7 aa, Artificial Sequence
  Made in Lab - CRDL2 from anti-Fzd VL chain
LGSNRAS

SEQ ID NO: 3184 - protein, 7 aa, Artificial Sequence
  Made in Lab - CRDL2 from anti-Fzd VL chain
AASSLQS

SEQ ID NO: 3185 - protein, 7 aa, Artificial Sequence
  Made in Lab - CRDL2 from anti-Fzd VL chain
KASSLEN

SEQ ID NO: 3186 - protein, 7 aa, Artificial Sequence
  Made in Lab - CRDL2 from anti-Fzd VL chain
GASNLQS

SEQ ID NO: 3187 - protein, 7 aa, Artificial Sequence
  Made in Lab - CRDL2 from anti-Fzd VL chain
AASTLQS

SEQ ID NO: 3188 - protein, 7 aa, Artificial Sequence
  Made in Lab - CRDL2 from anti-Fzd VL chain
KASSLES

SEQ ID NO: 3189 - protein, 7 aa, Artificial Sequence
  Made in Lab - CRDL2 from anti-Fzd VL chain
AASRLQS

SEQ ID NO: 3190 - protein, 7 aa, Artificial Sequence
  Made in Lab - CRDL2 from anti-Fzd VL chain
AASSLQS

SEQ ID NO: 3191 - protein, 7 aa, Artificial Sequence
  Made in Lab - CRDL2 from anti-Fzd VL chain
AASTLQS

SEQ ID NO: 3192 - protein, 7 aa, Artificial Sequence
  Made in Lab - CRDL2 from anti-Fzd VL chain
KASSLES

SEQ ID NO: 3193 - protein, 7 aa, Artificial Sequence
  Made in Lab - CRDL2 from anti-Fzd VL chain
LGSNRAS

SEQ ID NO: 3194 - protein, 7 aa, Artificial Sequence
  Made in Lab - CRDL2 from anti-Fzd VL chain
KASSLES

SEQ ID NO: 3195 - protein, 7 aa, Artificial Sequence
  Made in Lab - CRDL2 from anti-Fzd VL chain
LGSNRAS

SEQ ID NO: 3196 - protein, 7 aa, Artificial Sequence
  Made in Lab - CRDL2 from anti-Fzd VL chain
DISSRAS

SEQ ID NO: 3197 - protein, 7 aa, Artificial Sequence
  Made in Lab - CRDL2 from anti-Fzd VL chain
AASTLHS

SEQ ID NO: 3198 - protein, 7 aa, Artificial Sequence
  Made in Lab - CRDL2 from anti-Fzd VL chain
AASTLKS

SEQ ID NO: 3199 - protein, 7 aa, Artificial Sequence
  Made in Lab - CRDL2 from anti-Fzd VL chain
WASTRES

SEQ ID NO: 3200 - protein, 7 aa, Artificial Sequence
  Made in Lab - CRDL2 from anti-Fzd VL chain
DASSLQS

SEQ ID NO: 3201 - protein, 7 aa, Artificial Sequence
  Made in Lab - CRDL2 from anti-Fzd VL chain
LGSDRAS

SEQ ID NO: 3202 - protein, 7 aa, Artificial Sequence
  Made in Lab - CRDL2 from anti-Fzd VL chain
AASTLQS

SEQ ID NO: 3203 - protein, 7 aa, Artificial Sequence
  Made in Lab - CRDL2 from anti-Fzd VL chain
SASNLQS

SEQ ID NO: 3204 - protein, 7 aa, Artificial Sequence
  Made in Lab - CRDL2 from anti-Fzd VL chain
SVSNLQS

SEQ ID NO: 3205 - protein, 7 aa, Artificial Sequence
  Made in Lab - CRDL2 from anti-Fzd VL chain
AATTLRS

SEQ ID NO: 3206 - protein, 7 aa, Artificial Sequence
  Made in Lab - CRDL2 from anti-Fzd VL chain
AATTLRS

SEQ ID NO: 3207 - protein, 7 aa, Artificial Sequence
  Made in Lab - CRDL2 from anti-Fzd VL chain
AASNLQS

SEQ ID NO: 3208 - protein, 7 aa, Artificial Sequence
  Made in Lab - CRDL2 from anti-Fzd VL chain
AATTLRS

SEQ ID NO: 3209 - protein, 7 aa, Artificial Sequence
  Made in Lab - CRDL2 from anti-Fzd VL chain
GASTRAT

SEQ ID NO: 3210 - protein, 7 aa, Artificial Sequence
  Made in Lab - CRDL2 from anti-Fzd VL chain
DASNLET

SEQ ID NO: 3211 - protein, 7 aa, Artificial Sequence
  Made in Lab - CRDL2 from anti-Fzd VL chain
AASSLRS

SEQ ID NO: 3212 - protein, 7 aa, Artificial Sequence
  Made in Lab - CRDL2 from anti-Fzd VL chain
GASTRAT

SEQ ID NO: 3213 - protein, 7 aa, Artificial Sequence
  Made in Lab - CRDL2 from anti-Fzd VL chain
GASTRAT

SEQ ID NO: 3214 - protein, 7 aa, Artificial Sequence
  Made in Lab - CRDL2 from anti-Fzd VL chain
EDDQRPS

SEQ ID NO: 3215 - protein, 7 aa, Artificial Sequence
  Made in Lab - CRDL2 from anti-Fzd VL chain
AASSLQS

SEQ ID NO: 3216 - protein, 7 aa, Artificial Sequence
  Made in Lab - CRDL2 from anti-Fzd VL chain
RNTQRPS

SEQ ID NO: 3217 - protein, 7 aa, Artificial Sequence
  Made in Lab - CRDL2 from anti-Fzd VL chain
EDDQRPS

SEQ ID NO: 3218 - protein, 7 aa, Artificial Sequence
  Made in Lab - CRDL2 from anti-Fzd VL chain
KVSNRDS

SEQ ID NO: 3219 - protein, 7 aa, Artificial Sequence
  Made in Lab - CRDL2 from anti-Fzd VL chain
QDDQRPS

SEQ ID NO: 3220 - protein, 7 aa, Artificial Sequence
  Made in Lab - CRDL2 from anti-Fzd VL chain
RNNNRPS

SEQ ID NO: 3221 - protein, 7 aa, Artificial Sequence
  Made in Lab - CRDL2 from anti-Fzd VL chain
QDDQRPS

SEQ ID NO: 3222 - protein, 7 aa, Artificial Sequence
  Made in Lab - CRDL2 from anti-Fzd VL chain
QDNKRPS

SEQ ID NO: 3223 - protein, 7 aa, Artificial Sequence
  Made in Lab - CRDL2 from anti-Fzd VL chain
KVSDLDY

SEQ ID NO: 3224 - protein, 7 aa, Artificial Sequence
  Made in Lab - CRDL2 from anti-Fzd VL chain
RDNSRPS

SEQ ID NO: 3225 - protein, 7 aa, Artificial Sequence
  Made in Lab - CRDL2 from anti-Fzd VL chain
RNNNRPS

SEQ ID NO: 3226 - protein, 7 aa, Artificial Sequence
  Made in Lab - CRDL2 from anti-Fzd VL chain
QDDQRPS

SEQ ID NO: 3227 - protein, 7 aa, Artificial Sequence
  Made in Lab - CRDL2 from anti-Fzd VL chain
QDFQRPS

SEQ ID NO: 3228 - protein, 7 aa, Artificial Sequence
  Made in Lab - CRDL2 from anti-Fzd VL chain
GSNERPS

SEQ ID NO: 3229 - protein, 7 aa, Artificial Sequence
  Made in Lab - CRDL2 from anti-Fzd VL chain
QDDQRPS

SEQ ID NO: 3230 - protein, 7 aa, Artificial Sequence
  Made in Lab - CRDL2 from anti-Fzd VL chain
QDDQRPS

SEQ ID NO: 3231 - protein, 7 aa, Artificial Sequence
  Made in Lab - CRDL2 from anti-Fzd VL chain
RNNNRPS

SEQ ID NO: 3232 - protein, 7 aa, Artificial Sequence
  Made in Lab - CRDL2 from anti-Fzd VL chain
QDDQRPS

SEQ ID NO: 3233 - protein, 7 aa, Artificial Sequence
  Made in Lab - CRDL2 from anti-Fzd VL chain
RNNDRPS

SEQ ID NO: 3234 - protein, 7 aa, Artificial Sequence
  Made in Lab - CRDL2 from anti-Fzd VL chain
QDFQRPS

SEQ ID NO: 3235 - protein, 7 aa, Artificial Sequence
  Made in Lab - CRDL2 from anti-Fzd VL chain
LGSNRAS

SEQ ID NO: 3236 - protein, 7 aa, Artificial Sequence
  Made in Lab - CRDL2 from anti-Fzd VL chain
RSNNRPS

SEQ ID NO: 3237 - protein, 7 aa, Artificial Sequence
  Made in Lab - CRDL2 from anti-Fzd VL chain
QDDQRPS

SEQ ID NO: 3238 - protein, 7 aa, Artificial Sequence
  Made in Lab - CRDL2 from anti-Fzd VL chain
RNNNRPS

SEQ ID NO: 3239 - protein, 7 aa, Artificial Sequence
  Made in Lab - CRDL2 from anti-Fzd VL chain
KVSNRDS

SEQ ID NO: 3240 - protein, 7 aa, Artificial Sequence
  Made in Lab - CRDL2 from anti-Fzd VL chain
EVSHRPS

SEQ ID NO: 3241 - protein, 7 aa, Artificial Sequence
  Made in Lab - CRDL2 from anti-Fzd VL chain
RNNDRPS

SEQ ID NO: 3242 - protein, 7 aa, Artificial Sequence
  Made in Lab - CRDL2 from anti-Fzd VL chain
RNNNRPS

SEQ ID NO: 3243 - protein, 7 aa, Artificial Sequence
  Made in Lab - CRDL2 from anti-Fzd VL chain
LGSNRAS

SEQ ID NO: 3244 - protein, 7 aa, Artificial Sequence
  Made in Lab - CRDL2 from anti-Fzd VL chain
RNNNRPS

SEQ ID NO: 3245 - protein, 7 aa, Artificial Sequence
  Made in Lab - CRDL2 from anti-Fzd VL chain
LGSNRAS

SEQ ID NO: 3246 - protein, 7 aa, Artificial Sequence
  Made in Lab - CRDL2 from anti-Fzd VL chain
RNNDRPS

SEQ ID NO: 3247 - protein, 7 aa, Artificial Sequence
  Made in Lab - CRDL2 from anti-Fzd VL chain
RNNDRPS

SEQ ID NO: 3248 - protein, 7 aa, Artificial Sequence
  Made in Lab - CRDL2 from anti-Fzd VL chain
RNNNRPS

SEQ ID NO: 3249 - protein, 7 aa, Artificial Sequence
  Made in Lab - CRDL2 from anti-Fzd VL chain
RNNDRPS

SEQ ID NO: 3250 - protein, 7 aa, Artificial Sequence
  Made in Lab - CRDL2 from anti-Fzd VL chain
KVSNRDS

SEQ ID NO: 3251 - protein, 7 aa, Artificial Sequence
  Made in Lab - CRDL2 from anti-Fzd VL chain
RNNDRPS

SEQ ID NO: 3252 - protein, 7 aa, Artificial Sequence
  Made in Lab - CRDL2 from anti-Fzd VL chain
RNNDRPS

SEQ ID NO: 3253 - protein, 7 aa, Artificial Sequence
  Made in Lab - CRDL2 from anti-Fzd VL chain
KVSNRDS

SEQ ID NO: 3254 - protein, 7 aa, Artificial Sequence
  Made in Lab - CRDL2 from anti-Fzd VL chain
RNNNRPS

SEQ ID NO: 3255 - protein, 7 aa, Artificial Sequence
  Made in Lab - CRDL2 from anti-Fzd VL chain
ANNKRPS

SEQ ID NO: 3256 - protein, 7 aa, Artificial Sequence
  Made in Lab - CRDL2 from anti-Fzd VL chain
RNNNRPS

SEQ ID NO: 3257 - protein, 7 aa, Artificial Sequence
  Made in Lab - CRDL2 from anti-Fzd VL chain
RNNNRPS

SEQ ID NO: 3258 - protein, 7 aa, Artificial Sequence
  Made in Lab - CRDL2 from anti-Fzd VL chain
RNNDRPS

SEQ ID NO: 3259 - protein, 7 aa, Artificial Sequence
  Made in Lab - CRDL2 from anti-Fzd VL chain
QDDQRPS

SEQ ID NO: 3260 - protein, 7 aa, Artificial Sequence
  Made in Lab - CRDL2 from anti-Fzd VL chain
DNSKRPS

SEQ ID NO: 3261 - protein, 7 aa, Artificial Sequence
  Made in Lab - CRDL2 from anti-Fzd VL chain
RNNDRPS

SEQ ID NO: 3262 - protein, 7 aa, Artificial Sequence
  Made in Lab - CRDL2 from anti-Fzd VL chain
ENNKRPS

SEQ ID NO: 3263 - protein, 7 aa, Artificial Sequence
  Made in Lab - CRDL2 from anti-Fzd VL chain
RNNDRPS

SEQ ID NO: 3264 - protein, 7 aa, Artificial Sequence
  Made in Lab - CRDL2 from anti-Fzd VL chain
GVSNRPS

SEQ ID NO: 3265 - protein, 7 aa, Artificial Sequence
  Made in Lab - CRDL2 from anti-Fzd VL chain
LGSNRAS

SEQ ID NO: 3266 - protein, 7 aa, Artificial Sequence
  Made in Lab - CRDL2 from anti-Fzd VL chain
RTLDRPS

SEQ ID NO: 3267 - protein, 7 aa, Artificial Sequence
  Made in Lab - CRDL2 from anti-Fzd VL chain
RNNDRPS

SEQ ID NO: 3268 - protein, 7 aa, Artificial Sequence
  Made in Lab - CRDL2 from anti-Fzd VL chain
DDNQRPS

SEQ ID NO: 3269 - protein, 7 aa, Artificial Sequence
  Made in Lab - CRDL2 from anti-Fzd VL chain
RNNNRPS

SEQ ID NO: 3270 - protein, 7 aa, Artificial Sequence
  Made in Lab - CRDL2 from anti-Fzd VL chain
QVSNRDS

SEQ ID NO: 3271 - protein, 7 aa, Artificial Sequence
  Made in Lab - CRDL2 from anti-Fzd VL chain
DDDQRPS

SEQ ID NO: 3272 - protein, 7 aa, Artificial Sequence
  Made in Lab - CRDL2 from anti-Fzd VL chain
RNNDRPS

SEQ ID NO: 3273 - protein, 7 aa, Artificial Sequence
  Made in Lab - CRDL2 from anti-Fzd VL chain
KVSKRDS

SEQ ID NO: 3274 - protein, 7 aa, Artificial Sequence
  Made in Lab - CRDL2 from anti-Fzd VL chain
GNSNRPS

SEQ ID NO: 3275 - protein, 7 aa, Artificial Sequence
  Made in Lab - CRDL2 from anti-Fzd VL chain
GNSNRPS

SEQ ID NO: 3276 - protein, 7 aa, Artificial Sequence
  Made in Lab - CRDL2 from anti-Fzd VL chain
QVSNRDS

SEQ ID NO: 3277 - protein, 7 aa, Artificial Sequence
  Made in Lab - CRDL2 from anti-Fzd VL chain
QDDQRPS

SEQ ID NO: 3278 - protein, 7 aa, Artificial Sequence
  Made in Lab - CRDL2 from anti-Fzd VL chain
RNNNRPS

SEQ ID NO: 3279 - protein, 7 aa, Artificial Sequence
  Made in Lab - CRDL2 from anti-Fzd VL chain
RNNNRPS

SEQ ID NO: 3280 - protein, 7 aa, Artificial Sequence
  Made in Lab - CRDL2 from anti-Fzd VL chain
RNNDRPS

SEQ ID NO: 3281 - protein, 7 aa, Artificial Sequence
  Made in Lab - CRDL2 from anti-Fzd VL chain
RTLDRPS

SEQ ID NO: 3282 - protein, 7 aa, Artificial Sequence
  Made in Lab - CRDL2 from anti-Fzd VL chain
KVSNRDS

SEQ ID NO: 3283 - protein, 7 aa, Artificial Sequence
  Made in Lab - CRDL2 from anti-Fzd VL chain
SASNLQS

SEQ ID NO: 3284 - protein, 7 aa, Artificial Sequence
  Made in Lab - CRDL2 from anti-Fzd VL chain
LGSKRPS

SEQ ID NO: 3285 - protein, 7 aa, Artificial Sequence
  Made in Lab - CRDL2 from anti-Fzd VL chain
AASSLQS

SEQ ID NO: 3286 - protein, 7 aa, Artificial Sequence
  Made in Lab - CRDL2 from anti-Fzd VL chain
EVSNRAS

SEQ ID NO: 3287 - protein, 7 aa, Artificial Sequence
  Made in Lab - CRDL2 from anti-Fzd VL chain
AASSLQS

SEQ ID NO: 3288 - protein, 7 aa, Artificial Sequence
  Made in Lab - CRDL2 from anti-Fzd VL chain
AASSLQS

SEQ ID NO: 3289 - protein, 7 aa, Artificial Sequence
  Made in Lab - CRDL2 from anti-Fzd VL chain
AASSLQS

SEQ ID NO: 3290 - protein, 7 aa, Artificial Sequence
  Made in Lab - CRDL2 from anti-Fzd VL chain
AASTLQS

SEQ ID NO: 3291 - protein, 7 aa, Artificial Sequence
  Made in Lab - CRDL2 from anti-Fzd VL chain
DASNLET

SEQ ID NO: 3292 - protein, 7 aa, Artificial Sequence
  Made in Lab - CRDL2 from anti-Fzd VL chain
AASSLQS

SEQ ID NO: 3293 - protein, 7 aa, Artificial Sequence
  Made in Lab - CRDL2 from anti-Fzd VL chain
DASSLES

SEQ ID NO: 3294 - protein, 7 aa, Artificial Sequence
  Made in Lab - CRDL2 from anti-Fzd VL chain
AASSLQS

SEQ ID NO: 3295 - protein, 7 aa, Artificial Sequence
  Made in Lab - CRDL2 from anti-Fzd VL chain
LGSNRAS

SEQ ID NO: 3296 - protein, 7 aa, Artificial Sequence
  Made in Lab - CRDL2 from anti-Fzd VL chain
AASSLQS

SEQ ID NO: 3297 - protein, 7 aa, Artificial Sequence
  Made in Lab - CRDL2 from anti-Fzd VL chain
AASKLHS

SEQ ID NO: 3298 - protein, 7 aa, Artificial Sequence
  Made in Lab - CRDL2 from anti-Fzd VL chain
AASTLHT

SEQ ID NO: 3299 - protein, 7 aa, Artificial Sequence
  Made in Lab - CRDL2 from anti-Fzd VL chain
WASTRKS

SEQ ID NO: 3300 - protein, 7 aa, Artificial Sequence
  Made in Lab - CRDL2 from anti-Fzd VL chain
DASNLET

SEQ ID NO: 3301 - protein, 7 aa, Artificial Sequence
  Made in Lab - CRDL2 from anti-Fzd VL chain
WASTRES

SEQ ID NO: 3302 - protein, 7 aa, Artificial Sequence
  Made in Lab - CRDL2 from anti-Fzd VL chain
LGSNRAS

SEQ ID NO: 3303 - protein, 7 aa, Artificial Sequence
  Made in Lab - CRDL2 from anti-Fzd VL chain
AASSLQS

SEQ ID NO: 3304 - protein, 7 aa, Artificial Sequence
  Made in Lab - CRDL2 from anti-Fzd VL chain
AASSLQS

SEQ ID NO: 3305 - protein, 7 aa, Artificial Sequence
  Made in Lab - CRDL2 from anti-Fzd VL chain
AASTLQP

SEQ ID NO: 3306 - protein, 7 aa, Artificial Sequence
  Made in Lab - CRDL2 from anti-Fzd VL chain
LGSLRAS

SEQ ID NO: 3307 - protein, 7 aa, Artificial Sequence
  Made in Lab - CRDL2 from anti-Fzd VL chain
AASSLQS

SEQ ID NO: 3308 - protein, 7 aa, Artificial Sequence
  Made in Lab - CRDL2 from anti-Fzd VL chain
LGSTRAS

SEQ ID NO: 3309 - protein, 7 aa, Artificial Sequence
  Made in Lab - CRDL2 from anti-Fzd VL chain
AASNLHN

SEQ ID NO: 3310 - protein, 7 aa, Artificial Sequence
  Made in Lab - CRDL2 from anti-Fzd VL chain
AASSLQS

SEQ ID NO: 3311 - protein, 7 aa, Artificial Sequence
  Made in Lab - CRDL2 from anti-Fzd VL chain
AASSLQS

SEQ ID NO: 3312 - protein, 7 aa, Artificial Sequence
  Made in Lab - CRDL2 from anti-Fzd VL chain
AASTLQS

SEQ ID NO: 3313 - protein, 7 aa, Artificial Sequence
  Made in Lab - CRDL2 from anti-Fzd VL chain
GASARAT

SEQ ID NO: 3314 - protein, 7 aa, Artificial Sequence
  Made in Lab - CRDL2 from anti-Fzd VL chain
AASSLES

SEQ ID NO: 3315 - protein, 7 aa, Artificial Sequence
  Made in Lab - CRDL2 from anti-Fzd VL chain
AASSLQS

SEQ ID NO: 3316 - protein, 7 aa, Artificial Sequence
  Made in Lab - CRDL2 from anti-Fzd VL chain
GASTLQS

SEQ ID NO: 3317 - protein, 7 aa, Artificial Sequence
  Made in Lab - CRDL2 from anti-Fzd VL chain
GASSLQR

SEQ ID NO: 3318 - protein, 7 aa, Artificial Sequence
  Made in Lab - CRDL2 from anti-Fzd VL chain
DASNLET

SEQ ID NO: 3319 - protein, 7 aa, Artificial Sequence
  Made in Lab - CRDL2 from anti-Fzd VL chain
LGSNRAS

SEQ ID NO: 3320 - protein, 7 aa, Artificial Sequence
  Made in Lab - CRDL2 from anti-Fzd VL chain
AASSLQS

SEQ ID NO: 3321 - protein, 7 aa, Artificial Sequence
  Made in Lab - CRDL2 from anti-Fzd VL chain
AASSLQS

SEQ ID NO: 3322 - protein, 7 aa, Artificial Sequence
  Made in Lab - CRDL2 from anti-Fzd VL chain
DASSLES

SEQ ID NO: 3323 - protein, 7 aa, Artificial Sequence
  Made in Lab - CRDL2 from anti-Fzd VL chain
LASNRAS

SEQ ID NO: 3324 - protein, 7 aa, Artificial Sequence
  Made in Lab - CRDL2 from anti-Fzd VL chain
SASSLQS

SEQ ID NO: 3325 - protein, 13 aa, Artificial Sequence
  Made in Lab - CRDL2 from anti-Fzd VL chain
GWMNPYSGNTGYA

SEQ ID NO: 3326 - protein, 7 aa, Artificial Sequence
  Made in Lab - CRDL2 from anti-Fzd VL chain
LGSNRAS

SEQ ID NO: 3327 - protein, 7 aa, Artificial Sequence
  Made in Lab - CRDL2 from anti-Fzd VL chain
AASNLET

SEQ ID NO: 3328 - protein, 7 aa, Artificial Sequence
  Made in Lab - CRDL2 from anti-Fzd VL chain
LGSNRAS

SEQ ID NO: 3329 - protein, 7 aa, Artificial Sequence
  Made in Lab - CRDL2 from anti-Fzd VL chain
DASTLQS

SEQ ID NO: 3330 - protein, 7 aa, Artificial Sequence
  Made in Lab - CRDL2 from anti-Fzd VL chain
KASSLES

SEQ ID NO: 3331 - protein, 7 aa, Artificial Sequence
  Made in Lab - CRDL2 from anti-Fzd VL chain
LGSNRAS

SEQ ID NO: 3332 - protein, 7 aa, Artificial Sequence
  Made in Lab - CRDL2 from anti-Fzd VL chain
DASTLQS

SEQ ID NO: 3333 - protein, 7 aa, Artificial Sequence
  Made in Lab - CRDL2 from anti-Fzd VL chain
WASTRES

SEQ ID NO: 3334 - protein, 7 aa, Artificial Sequence
  Made in Lab - CRDL2 from anti-Fzd VL chain
LGSNRAS

SEQ ID NO: 3335 - protein, 7 aa, Artificial Sequence
  Made in Lab - CRDL2 from anti-Fzd VL chain
LGSNRAS

SEQ ID NO: 3336 - protein, 7 aa, Artificial Sequence
  Made in Lab - CRDL2 from anti-Fzd VL chain
WASARES

SEQ ID NO: 3337 - protein, 7 aa, Artificial Sequence
  Made in Lab - CRDL2 from anti-Fzd VL chain
AASSLQS

SEQ ID NO: 3338 - protein, 7 aa, Artificial Sequence
  Made in Lab - CRDL2 from anti-Fzd VL chain
LGSNRAS

SEQ ID NO: 3339 - protein, 7 aa, Artificial Sequence
  Made in Lab - CRDL2 from anti-Fzd VL chain
LGSNRAS

SEQ ID NO: 3340 - protein, 7 aa, Artificial Sequence
  Made in Lab - CRDL2 from anti-Fzd VL chain
LGSDRAS

SEQ ID NO: 3341 - protein, 7 aa, Artificial Sequence
  Made in Lab - CRDL2 from anti-Fzd VL chain
LGSNRAS

SEQ ID NO: 3342 - protein, 7 aa, Artificial Sequence
  Made in Lab - CRDL2 from anti-Fzd VL chain
DASNLVT

SEQ ID NO: 3343 - protein, 7 aa, Artificial Sequence
  Made in Lab - CRDL2 from anti-Fzd VL chain
LASNRAS

SEQ ID NO: 3344 - protein, 7 aa, Artificial Sequence
  Made in Lab - CRDL2 from anti-Fzd VL chain
LVSKLDS

SEQ ID NO: 3345 - protein, 7 aa, Artificial Sequence
  Made in Lab - CRDL2 from anti-Fzd VL chain
AASNLAT

SEQ ID NO: 3346 - protein, 7 aa, Artificial Sequence
  Made in Lab - CRDL2 from anti-Fzd VL chain
LGSNRAS

SEQ ID NO: 3347 - protein, 7 aa, Artificial Sequence
  Made in Lab - CRDL2 from anti-Fzd VL chain
GASRLET

SEQ ID NO: 3348 - protein, 7 aa, Artificial Sequence
  Made in Lab - CRDL2 from anti-Fzd VL chain
LGSNZQS

SEQ ID NO: 3349 - protein, 7 aa, Artificial Sequence
  Made in Lab - CRDL2 from anti-Fzd VL chain
DASTLQS

SEQ ID NO: 3350 - protein, 7 aa, Artificial Sequence
  Made in Lab - CRDL2 from anti-Fzd VL chain
RVSSLQT

SEQ ID NO: 3351 - protein, 7 aa, Artificial Sequence
  Made in Lab - CRDL2 from anti-Fzd VL chain
DATNLPT

SEQ ID NO: 3352 - protein, 7 aa, Artificial Sequence
  Made in Lab - CRDL2 from anti-Fzd VL chain
AASSLQS

SEQ ID NO: 3353 - protein, 7 aa, Artificial Sequence
  Made in Lab - CRDL2 from anti-Fzd VL chain
GASSRQS

SEQ ID NO: 3354 - protein, 7 aa, Artificial Sequence
  Made in Lab - CRDL2 from anti-Fzd VL chain
DASSLQS

SEQ ID NO: 3355 - protein, 7 aa, Artificial Sequence
  Made in Lab - CRDL2 from anti-Fzd VL chain
DASTLQS

SEQ ID NO: 3356 - protein, 7 aa, Artificial Sequence
  Made in Lab - CRDL2 from anti-Fzd VL chain
GASTLQS

SEQ ID NO: 3357 - protein, 7 aa, Artificial Sequence
  Made in Lab - CRDL2 from anti-Fzd VL chain
WASTRES

SEQ ID NO: 3358 - protein, 7 aa, Artificial Sequence
  Made in Lab - CRDL2 from anti-Fzd VL chain
WASTRES

SEQ ID NO: 3359 - protein, 7 aa, Artificial Sequence
  Made in Lab - CRDL2 from anti-Fzd VL chain
GASSLET

SEQ ID NO: 3360 - protein, 7 aa, Artificial Sequence
  Made in Lab - CRDL2 from anti-Fzd VL chain
ZASRWQS

SEQ ID NO: 3361 - protein, 7 aa, Artificial Sequence
  Made in Lab - CRDL2 from anti-Fzd VL chain
GASTLES

SEQ ID NO: 3362 - protein, 7 aa, Artificial Sequence
  Made in Lab - CRDL2 from anti-Fzd VL chain
LGSNRAS

SEQ ID NO: 3363 - protein, 7 aa, Artificial Sequence
  Made in Lab - CRDL2 from anti-Fzd VL chain
DASTLQS

SEQ ID NO: 3364 - protein, 7 aa, Artificial Sequence
  Made in Lab - CRDL2 from anti-Fzd VL chain
ZASTRES

SEQ ID NO: 3365 - protein, 7 aa, Artificial Sequence
  Made in Lab - CRDL2 from anti-Fzd VL chain
AASILQT

SEQ ID NO: 3366 - protein, 7 aa, Artificial Sequence
  Made in Lab - CRDL2 from anti-Fzd VL chain
DASTLQS

SEQ ID NO: 3367 - protein, 7 aa, Artificial Sequence
  Made in Lab - CRDL2 from anti-Fzd VL chain
GASTLQS

SEQ ID NO: 3368 - protein, 7 aa, Artificial Sequence
  Made in Lab - CRDL2 from anti-Fzd VL chain
AASSLQS

SEQ ID NO: 3369 - protein, 7 aa, Artificial Sequence
  Made in Lab - CRDL2 from anti-Fzd VL chain
DASTLQS

SEQ ID NO: 3370 - protein, 7 aa, Artificial Sequence
  Made in Lab - CRDL2 from anti-Fzd VL chain
SASTLES

SEQ ID NO: 3371 - protein, 7 aa, Artificial Sequence
  Made in Lab - CRDL2 from anti-Fzd VL chain
AASSLQS

SEQ ID NO: 3372 - protein, 7 aa, Artificial Sequence
  Made in Lab - CRDL2 from anti-Fzd VL chain
WASARHS

SEQ ID NO: 3373 - protein, 7 aa, Artificial Sequence
  Made in Lab - CRDL2 from anti-Fzd VL chain
GASTLHS

SEQ ID NO: 3374 - protein, 7 aa, Artificial Sequence
  Made in Lab - CRDL2 from anti-Fzd VL chain
DASTLQS

SEQ ID NO: 3375 - protein, 7 aa, Artificial Sequence
  Made in Lab - CRDL2 from anti-Fzd VL chain
AASSLQS

SEQ ID NO: 3376 - protein, 7 aa, Artificial Sequence
  Made in Lab - CRDL2 from anti-Fzd VL chain
DGSFLET

SEQ ID NO: 3377 - protein, 7 aa, Artificial Sequence
  Made in Lab - CRDL2 from anti-Fzd VL chain
WASTRES

SEQ ID NO: 3378 - protein, 7 aa, Artificial Sequence
  Made in Lab - CRDL2 from anti-Fzd VL chain
SASZLES

SEQ ID NO: 3379 - protein, 7 aa, Artificial Sequence
  Made in Lab - CRDL2 from anti-Fzd VL chain
DASNLET

SEQ ID NO: 3380 - protein, 7 aa, Artificial Sequence
  Made in Lab - CRDL2 from anti-Fzd VL chain
AASTLQS

SEQ ID NO: 3381 - protein, 7 aa, Artificial Sequence
  Made in Lab - CRDL2 from anti-Fzd VL chain
GASSLQS

SEQ ID NO: 3382 - protein, 7 aa, Artificial Sequence
  Made in Lab - CRDL2 from anti-Fzd VL chain
DASNLET

SEQ ID NO: 3383 - protein, 7 aa, Artificial Sequence
  Made in Lab - CRDL2 from anti-Fzd VL chain
AASRLQT

SEQ ID NO: 3384 - protein, 7 aa, Artificial Sequence
  Made in Lab - CRDL2 from anti-Fzd VL chain
GASSLQS

SEQ ID NO: 3385 - protein, 7 aa, Artificial Sequence
  Made in Lab - CRDL2 from anti-Fzd VL chain
AASSLQS

SEQ ID NO: 3386 - protein, 7 aa, Artificial Sequence
  Made in Lab - CRDL2 from anti-Fzd VL chain
DASNLET

SEQ ID NO: 3387 - protein, 7 aa, Artificial Sequence
  Made in Lab - CRDL2 from anti-Fzd VL chain
GASNLQS

SEQ ID NO: 3388 - protein, 7 aa, Artificial Sequence
  Made in Lab - CRDL2 from anti-Fzd VL chain
GASSLQS

SEQ ID NO: 3389 - protein, 7 aa, Artificial Sequence
  Made in Lab - CRDL2 from anti-Fzd VL chain
RVSSLQT

SEQ ID NO: 3390 - protein, 7 aa, Artificial Sequence
  Made in Lab - CRDL2 from anti-Fzd VL chain
WASTRES

SEQ ID NO: 3391 - protein, 7 aa, Artificial Sequence
  Made in Lab - CRDL2 from anti-Fzd VL chain
KASSLES

SEQ ID NO: 3392 - protein, 7 aa, Artificial Sequence
  Made in Lab - CRDL2 from anti-Fzd VL chain
WASTRDS

SEQ ID NO: 3393 - protein, 7 aa, Artificial Sequence
  Made in Lab - CRDL2 from anti-Fzd VL chain
AASSLQS

SEQ ID NO: 3394 - protein, 7 aa, Artificial Sequence
  Made in Lab - CRDL2 from anti-Fzd VL chain
AASSLQS

SEQ ID NO: 3395 - protein, 7 aa, Artificial Sequence
  Made in Lab - CRDL2 from anti-Fzd VL chain
AASRLQS

SEQ ID NO: 3396 - protein, 7 aa, Artificial Sequence
  Made in Lab - CRDL2 from anti-Fzd VL chain
DASNLET

SEQ ID NO: 3397 - protein, 7 aa, Artificial Sequence
  Made in Lab - CRDL2 from anti-Fzd VL chain
WASTRQS

SEQ ID NO: 3398 - protein, 7 aa, Artificial Sequence
  Made in Lab - CRDL2 from anti-Fzd VL chain
AASSLQS

SEQ ID NO: 3399 - protein, 7 aa, Artificial Sequence
  Made in Lab - CRDL2 from anti-Fzd VL chain
LGSNRAS

SEQ ID NO: 3400 - protein, 7 aa, Artificial Sequence
  Made in Lab - CRDL2 from anti-Fzd VL chain
WASTRES

SEQ ID NO: 3401 - protein, 7 aa, Artificial Sequence
  Made in Lab - CRDL2 from anti-Fzd VL chain
GASSLQS

SEQ ID NO: 3402 - protein, 7 aa, Artificial Sequence
  Made in Lab - CRDL2 from anti-Fzd VL chain
AASSLQS

SEQ ID NO: 3403 - protein, 7 aa, Artificial Sequence
  Made in Lab - CRDL2 from anti-Fzd VL chain
DASTLQS

SEQ ID NO: 3404 - protein, 7 aa, Artificial Sequence
  Made in Lab - CRDL2 from anti-Fzd VL chain
DASNLET

SEQ ID NO: 3405 - protein, 7 aa, Artificial Sequence
  Made in Lab - CRDL2 from anti-Fzd VL chain
WASTRES

SEQ ID NO: 3406 - protein, 7 aa, Artificial Sequence
  Made in Lab - CRDL2 from anti-Fzd VL chain
SASTLQS

SEQ ID NO: 3407 - protein, 7 aa, Artificial Sequence
  Made in Lab - CRDL2 from anti-Fzd VL chain
AASSLQS

SEQ ID NO: 3408 - protein, 7 aa, Artificial Sequence
  Made in Lab - CRDL2 from anti-Fzd VL chain
DASTLQS

SEQ ID NO: 3409 - protein, 7 aa, Artificial Sequence
  Made in Lab - CRDL2 from anti-Fzd VL chain
AASSLQS

SEQ ID NO: 3410 - protein, 7 aa, Artificial Sequence
  Made in Lab - CRDL2 from anti-Fzd VL chain
GASSLQS

SEQ ID NO: 3411 - protein, 7 aa, Artificial Sequence
  Made in Lab - CRDL2 from anti-Fzd VL chain
AASSLQS

SEQ ID NO: 3412 - protein, 7 aa, Artificial Sequence
  Made in Lab - CRDL2 from anti-Fzd VL chain
EVSNRFS

SEQ ID NO: 3413 - protein, 7 aa, Artificial Sequence
  Made in Lab - CRDL2 from anti-Fzd VL chain
AASRLQS

SEQ ID NO: 3414 - protein, 7 aa, Artificial Sequence
  Made in Lab - CRDL2 from anti-Fzd VL chain
AASSLQS

SEQ ID NO: 3415 - protein, 7 aa, Artificial Sequence
  Made in Lab - CRDL2 from anti-Fzd VL chain
SASSLHS

SEQ ID NO: 3416 - protein, 7 aa, Artificial Sequence
  Made in Lab - CRDL2 from anti-Fzd VL chain
WASTRES

SEQ ID NO: 3417 - protein, 7 aa, Artificial Sequence
  Made in Lab - CRDL2 from anti-Fzd VL chain
DASTLQS

SEQ ID NO: 3418 - protein, 7 aa, Artificial Sequence
  Made in Lab - CRDL2 from anti-Fzd VL chain
AASSLQS

SEQ ID NO: 3419 - protein, 7 aa, Artificial Sequence
  Made in Lab - CRDL2 from anti-Fzd VL chain
AASSLQS

SEQ ID NO: 3420 - protein, 7 aa, Artificial Sequence
  Made in Lab - CRDL2 from anti-Fzd VL chain
DASTLQS

SEQ ID NO: 3421 - protein, 7 aa, Artificial Sequence
  Made in Lab - CRDL2 from anti-Fzd VL chain
QASSLES

SEQ ID NO: 3422 - protein, 7 aa, Artificial Sequence
  Made in Lab - CRDL2 from anti-Fzd VL chain
LASNRAS

SEQ ID NO: 3423 - protein, 7 aa, Artificial Sequence
  Made in Lab - CRDL2 from anti-Fzd VL chain
WASTRAS

SEQ ID NO: 3424 - protein, 7 aa, Artificial Sequence
  Made in Lab - CRDL2 from anti-Fzd VL chain
SASNLQS

SEQ ID NO: 3425 - protein, 7 aa, Artificial Sequence
  Made in Lab - CRDL2 from anti-Fzd VL chain
KASSLES

SEQ ID NO: 3426 - protein, 7 aa, Artificial Sequence
  Made in Lab - CRDL2 from anti-Fzd VL chain
DASTLQS

SEQ ID NO: 3427 - protein, 7 aa, Artificial Sequence
  Made in Lab - CRDL2 from anti-Fzd VL chain
DASTLQS

SEQ ID NO: 3428 - protein, 7 aa, Artificial Sequence
  Made in Lab - CRDL2 from anti-Fzd VL chain
AASSLZS

SEQ ID NO: 3429 - protein, 7 aa, Artificial Sequence
  Made in Lab - CRDL2 from anti-Fzd VL chain
AASSLQS

SEQ ID NO: 3430 - protein, 7 aa, Artificial Sequence
  Made in Lab - CRDL2 from anti-Fzd VL chain
AASILHS

SEQ ID NO: 3431 - protein, 7 aa, Artificial Sequence
  Made in Lab - CRDL2 from anti-Fzd VL chain
AASSLQS

SEQ ID NO: 3432 - protein, 7 aa, Artificial Sequence
  Made in Lab - CRDL2 from anti-Fzd VL chain
DASTLQS

SEQ ID NO: 3433 - protein, 7 aa, Artificial Sequence
  Made in Lab - CRDL2 from anti-Fzd VL chain
QASSLES

SEQ ID NO: 3434 - protein, 7 aa, Artificial Sequence
  Made in Lab - CRDL2 from anti-Fzd VL chain
GASSLQS

SEQ ID NO: 3435 - protein, 7 aa, Artificial Sequence
  Made in Lab - CRDL2 from anti-Fzd VL chain
LASNRAS

SEQ ID NO: 3436 - protein, 7 aa, Artificial Sequence
  Made in Lab - CRDL2 from anti-Fzd VL chain
SASTLES

SEQ ID NO: 3437 - protein, 7 aa, Artificial Sequence
  Made in Lab - CRDL2 from anti-Fzd VL chain
AASSLQS

SEQ ID NO: 3438 - protein, 7 aa, Artificial Sequence
  Made in Lab - CRDL2 from anti-Fzd VL chain
SASTLES

SEQ ID NO: 3439 - protein, 7 aa, Artificial Sequence
  Made in Lab - CRDL2 from anti-Fzd VL chain
SASNLQS

SEQ ID NO: 3440 - protein, 7 aa, Artificial Sequence
  Made in Lab - CRDL2 from anti-Fzd VL chain
WASTRES

SEQ ID NO: 3441 - protein, 7 aa, Artificial Sequence
  Made in Lab - CRDL2 from anti-Fzd VL chain
AASNLEI

SEQ ID NO: 3442 - protein, 7 aa, Artificial Sequence
  Made in Lab - CRDL2 from anti-Fzd VL chain
AASSLQS

SEQ ID NO: 3443 - protein, 7 aa, Artificial Sequence
  Made in Lab - CRDL2 from anti-Fzd VL chain
DASTLQS

SEQ ID NO: 3444 - protein, 7 aa, Artificial Sequence
  Made in Lab - CRDL2 from anti-Fzd VL chain
WASTRQS

SEQ ID NO: 3445 - protein, 7 aa, Artificial Sequence
  Made in Lab - CRDL2 from anti-Fzd VL chain
LGSNRAS

SEQ ID NO: 3446 - protein, 7 aa, Artificial Sequence
  Made in Lab - CRDL2 from anti-Fzd VL chain
QGSRRAP

SEQ ID NO: 3447 - protein, 7 aa, Artificial Sequence
  Made in Lab - CRDL2 from anti-Fzd VL chain
SASSLQS

SEQ ID NO: 3448 - protein, 7 aa, Artificial Sequence
  Made in Lab - CRDL2 from anti-Fzd VL chain
AASSLQS

SEQ ID NO: 3449 - protein, 7 aa, Artificial Sequence
  Made in Lab - CRDL2 from anti-Fzd VL chain
AASSLQS

SEQ ID NO: 3450 - protein, 7 aa, Artificial Sequence
  Made in Lab - CRDL2 from anti-Fzd VL chain
ATATLNS

SEQ ID NO: 3451 - protein, 7 aa, Artificial Sequence
  Made in Lab - CRDL2 from anti-Fzd VL chain
DASNLEA

SEQ ID NO: 3452 - protein, 7 aa, Artificial Sequence
  Made in Lab - CRDL2 from anti-Fzd VL chain
DASSLES

SEQ ID NO: 3453 - protein, 7 aa, Artificial Sequence
  Made in Lab - CRDL2 from anti-Fzd VL chain
AASTLQS

SEQ ID NO: 3454 - protein, 7 aa, Artificial Sequence
  Made in Lab - CRDL2 from anti-Fzd VL chain
GASTLHS

SEQ ID NO: 3455 - protein, 7 aa, Artificial Sequence
  Made in Lab - CRDL2 from anti-Fzd VL chain
KASSLES

SEQ ID NO: 3456 - protein, 7 aa, Artificial Sequence
  Made in Lab - CRDL2 from anti-Fzd VL chain
DASNLGT

SEQ ID NO: 3457 - protein, 7 aa, Artificial Sequence
  Made in Lab - CRDL2 from anti-Fzd VL chain
LGSNRAS

SEQ ID NO: 3458 - protein, 7 aa, Artificial Sequence
  Made in Lab - CRDL2 from anti-Fzd VL chain
DASSLQS

SEQ ID NO: 3459 - protein, 7 aa, Artificial Sequence
  Made in Lab - CRDL2 from anti-Fzd VL chain
SASNLQS

SEQ ID NO: 3460 - protein, 7 aa, Artificial Sequence
  Made in Lab - CRDL2 from anti-Fzd VL chain
DASYLEA

SEQ ID NO: 3461 - protein, 7 aa, Artificial Sequence
  Made in Lab - CRDL2 from anti-Fzd VL chain
WASTRES

SEQ ID NO: 3462 - protein, 7 aa, Artificial Sequence
  Made in Lab - CRDL2 from anti-Fzd VL chain
LGSSRAS

SEQ ID NO: 3463 - protein, 7 aa, Artificial Sequence
  Made in Lab - CRDL2 from anti-Fzd VL chain
AASSLQS

SEQ ID NO: 3464 - protein, 7 aa, Artificial Sequence
  Made in Lab - CRDL2 from anti-Fzd VL chain
LGSDRAS

SEQ ID NO: 3465 - protein, 7 aa, Artificial Sequence
  Made in Lab - CRDL2 from anti-Fzd VL chain
LGSDRAS

SEQ ID NO: 3466 - protein, 7 aa, Artificial Sequence
  Made in Lab - CRDL2 from anti-Fzd VL chain
DASNLET

SEQ ID NO: 3467 - protein, 7 aa, Artificial Sequence
  Made in Lab - CRDL2 from anti-Fzd VL chain
SGSNRAS

SEQ ID NO: 3468 - protein, 7 aa, Artificial Sequence
  Made in Lab - CRDL2 from anti-Fzd VL chain
WASTRES

SEQ ID NO: 3469 - protein, 7 aa, Artificial Sequence
  Made in Lab - CRDL2 from anti-Fzd VL chain
AASTLQS

SEQ ID NO: 3470 - protein, 7 aa, Artificial Sequence
  Made in Lab - CRDL2 from anti-Fzd VL chain
GASSLQS

SEQ ID NO: 3471 - protein, 7 aa, Artificial Sequence
  Made in Lab - CRDL2 from anti-Fzd VL chain
LGSNRAS

SEQ ID NO: 3472 - protein, 7 aa, Artificial Sequence
  Made in Lab - CRDL2 from anti-Fzd VL chain
AASSLQS

SEQ ID NO: 3473 - protein, 7 aa, Artificial Sequence
  Made in Lab - CRDL2 from anti-Fzd VL chain
GASTRAT

SEQ ID NO: 3474 - protein, 7 aa, Artificial Sequence
  Made in Lab - CRDL2 from anti-Fzd VL chain
AASTLQS

SEQ ID NO: 3475 - protein, 7 aa, Artificial Sequence
  Made in Lab - CRDL2 from anti-Fzd VL chain
DASNLET

SEQ ID NO: 3476 - protein, 7 aa, Artificial Sequence
  Made in Lab - CRDL2 from anti-Fzd VL chain
LGSNRAS

SEQ ID NO: 3477 - protein, 7 aa, Artificial Sequence
  Made in Lab - CRDL2 from anti-Fzd VL chain
LGSNRAS

SEQ ID NO: 3478 - protein, 7 aa, Artificial Sequence
  Made in Lab - CRDL2 from anti-Fzd VL chain
LGSDRAS

SEQ ID NO: 3479 - protein, 7 aa, Artificial Sequence
  Made in Lab - CRDL2 from anti-Fzd VL chain
LGSNRAS

SEQ ID NO: 3480 - protein, 7 aa, Artificial Sequence
  Made in Lab - CRDL2 from anti-Fzd VL chain
EASTLEH

SEQ ID NO: 3481 - protein, 7 aa, Artificial Sequence
  Made in Lab - CRDL2 from anti-Fzd VL chain
DASSLET

SEQ ID NO: 3482 - protein, 7 aa, Artificial Sequence
  Made in Lab - CRDL2 from anti-Fzd VL chain
DASNLET

SEQ ID NO: 3483 - protein, 7 aa, Artificial Sequence
  Made in Lab - CRDL2 from anti-Fzd VL chain
AASSLQS

SEQ ID NO: 3484 - protein, 7 aa, Artificial Sequence
  Made in Lab - CRDL2 from anti-Fzd VL chain
DASTLQS

SEQ ID NO: 3485 - protein, 7 aa, Artificial Sequence
  Made in Lab - CRDL2 from anti-Fzd VL chain
DASNLDA

SEQ ID NO: 3486 - protein, 7 aa, Artificial Sequence
  Made in Lab - CRDL2 from anti-Fzd VL chain
EVSNRAS

SEQ ID NO: 3487 - protein, 7 aa, Artificial Sequence
  Made in Lab - CRDL2 from anti-Fzd VL chain
AASSLQS

SEQ ID NO: 3488 - protein, 7 aa, Artificial Sequence
  Made in Lab - CRDL2 from anti-Fzd VL chain
AASTLES

SEQ ID NO: 3489 - protein, 7 aa, Artificial Sequence
  Made in Lab - CRDL2 from anti-Fzd VL chain
DASNLET

SEQ ID NO: 3490 - protein, 7 aa, Artificial Sequence
  Made in Lab - CRDL2 from anti-Fzd VL chain
GASNLQS

SEQ ID NO: 3491 - protein, 7 aa, Artificial Sequence
  Made in Lab - CRDL2 from anti-Fzd VL chain
AASSLQS

SEQ ID NO: 3492 - protein, 7 aa, Artificial Sequence
  Made in Lab - CRDL2 from anti-Fzd VL chain
SGSNRAS

SEQ ID NO: 3493 - protein, 7 aa, Artificial Sequence
  Made in Lab - CRDL2 from anti-Fzd VL chain
PGNILQG

SEQ ID NO: 3494 - protein, 7 aa, Artificial Sequence
  Made in Lab - CRDL2 from anti-Fzd VL chain
GASNVQS

SEQ ID NO: 3495 - protein, 7 aa, Artificial Sequence
  Made in Lab - CRDL2 from anti-Fzd VL chain
EASSLAS

SEQ ID NO: 3496 - protein, 7 aa, Artificial Sequence
  Made in Lab - CRDL2 from anti-Fzd VL chain
LGSNRAS

SEQ ID NO: 3497 - protein, 7 aa, Artificial Sequence
  Made in Lab - CRDL2 from anti-Fzd VL chain
KASTLDS

SEQ ID NO: 3498 - protein, 7 aa, Artificial Sequence
  Made in Lab - CRDL2 from anti-Fzd VL chain
AASSLQS

SEQ ID NO: 3499 - protein, 7 aa, Artificial Sequence
  Made in Lab - CRDL2 from anti-Fzd VL chain
LGSNRAS

SEQ ID NO: 3500 - protein, 7 aa, Artificial Sequence
  Made in Lab - CRDL2 from anti-Fzd VL chain
LGSNRAS

SEQ ID NO: 3501 - protein, 7 aa, Artificial Sequence
  Made in Lab - CRDL2 from anti-Fzd VL chain
AASTLHS

SEQ ID NO: 3502 - protein, 7 aa, Artificial Sequence
  Made in Lab - CRDL2 from anti-Fzd VL chain
DASNLET

SEQ ID NO: 3503 - protein, 7 aa, Artificial Sequence
  Made in Lab - CRDL2 from anti-Fzd VL chain
DVSTLQS

SEQ ID NO: 3504 - protein, 7 aa, Artificial Sequence
  Made in Lab - CRDL2 from anti-Fzd VL chain
LGSNRAS

SEQ ID NO: 3505 - protein, 7 aa, Artificial Sequence
  Made in Lab - CRDL2 from anti-Fzd VL chain
GASNLQS

SEQ ID NO: 3506 - protein, 7 aa, Artificial Sequence
  Made in Lab - CRDL2 from anti-Fzd VL chain
WASTRES

SEQ ID NO: 3507 - protein, 7 aa, Artificial Sequence
  Made in Lab - CRDL2 from anti-Fzd VL chain
LGSNRAS

SEQ ID NO: 3508 - protein, 7 aa, Artificial Sequence
  Made in Lab - CRDL2 from anti-Fzd VL chain
SGSNRAS

SEQ ID NO: 3509 - protein, 7 aa, Artificial Sequence
  Made in Lab - CRDL2 from anti-Fzd VL chain
LGSNRAS

SEQ ID NO: 3510 - protein, 11 aa, Artificial Sequence [sequence omitted]

SEQ ID NO: 3511 - protein, 11 aa, Artificial Sequence [sequence omitted]

SEQ ID NO: 3512 - protein, 11 aa, Artificial Sequence [sequence omitted]

SEQ ID NO: 3513 - protein, 11 aa, Artificial Sequence [sequence omitted]

SEQ ID NO: 3514 - protein, 11 aa, Artificial Sequence [sequence omitted]

SEQ ID NO: 3515 - protein, 11 aa, Artificial Sequence [sequence omitted]

SEQ ID NO: 3516 - protein, 11 aa, Artificial Sequence [sequence omitted]

SEQ ID NO: 3517 - protein, 11 aa, Artificial Sequence [sequence omitted]

SEQ ID NO: 3518 - protein, 11 aa, Artificial Sequence [sequence omitted]

SEQ ID NO: 3519 - protein, 11 aa, Artificial Sequence [sequence omitted]

SEQ ID NO: 3520 - protein, 11 aa, Artificial Sequence [sequence omitted]

SEQ ID NO: 3521 - protein, 11 aa, Artificial Sequence [sequence omitted]

SEQ ID NO: 3522 - protein, 11 aa, Artificial Sequence [sequence omitted]

SEQ ID NO: 3523 - protein, 11 aa, Artificial Sequence [sequence omitted]

SEQ ID NO: 3524 - protein, 11 aa, Artificial Sequence [sequence omitted]

SEQ ID NO: 3525 - protein, 11 aa, Artificial Sequence [sequence omitted]

SEQ ID NO: 3526 - protein, 11 aa, Artificial Sequence [sequence omitted]

SEQ ID NO: 3527 - protein, 11 aa, Artificial Sequence [sequence omitted]

SEQ ID NO: 3528 - protein, 11 aa, Artificial Sequence [sequence omitted]

SEQ ID NO: 3529 - protein, 11 aa, Artificial Sequence [sequence omitted]

SEQ ID NO: 3530 - protein, 11 aa, Artificial Sequence [sequence omitted]

SEQ ID NO: 3531 - protein, 11 aa, Artificial Sequence [sequence omitted]

SEQ ID NO: 3532 - protein, 11 aa, Artificial Sequence [sequence omitted]

SEQ ID NO: 3533 - protein, 11 aa, Artificial Sequence [sequence omitted]

SEQ ID NO: 3534 - protein, 11 aa, Artificial Sequence [sequence omitted]

SEQ ID NO: 3535 - protein, 11 aa, Artificial Sequence [sequence omitted]

SEQ ID NO: 3536 - protein, 11 aa, Artificial Sequence [sequence omitted]

SEQ ID NO: 3537 - protein, 11 aa, Artificial Sequence [sequence omitted]

SEQ ID NO: 3538 - protein, 11 aa, Artificial Sequence [sequence omitted]

SEQ ID NO: 3539 - protein, 11 aa, Artificial Sequence
  Made in Lab - CRDL3 from anti-Fzd VL chain
CMQTLKTPLSF

SEQ ID NO: 3540 - protein, 11 aa, Artificial Sequence [sequence omitted]

SEQ ID NO: 3541 - protein, 11 aa, Artificial Sequence [sequence omitted]

SEQ ID NO: 3542 - protein, 11 aa, Artificial Sequence [sequence omitted]

SEQ ID NO: 3543 - protein, 11 aa, Artificial Sequence [sequence omitted]

SEQ ID NO: 3544 - protein, 11 aa, Artificial Sequence [sequence omitted]

SEQ ID NO: 3545 - protein, 11 aa, Artificial Sequence
  Made in Lab - CRDL3 from anti-Fzd VL chain
CMQAVQVPITF

SEQ ID NO: 3546 - protein, 11 aa, Artificial Sequence [sequence omitted]

SEQ ID NO: 3547 - protein, 11 aa, Artificial Sequence [sequence omitted]

SEQ ID NO: 3548 - protein, 11 aa, Artificial Sequence [sequence omitted]

SEQ ID NO: 3549 - protein, 11 aa, Artificial Sequence [sequence omitted]

SEQ ID NO: 3550 - protein, 11 aa, Artificial Sequence [sequence omitted]

SEQ ID NO: 3551 - protein, 11 aa, Artificial Sequence [sequence omitted]

SEQ ID NO: 3552 - protein, 11 aa, Artificial Sequence [sequence omitted]

SEQ ID NO: 3553 - protein, 11 aa, Artificial Sequence [sequence omitted]

SEQ ID NO: 3554 - protein, 11 aa, Artificial Sequence [sequence omitted]

SEQ ID NO: 3555 - protein, 11 aa, Artificial Sequence [sequence omitted]

SEQ ID NO: 3556 - protein, 11 aa, Artificial Sequence [sequence omitted]

SEQ ID NO: 3557 - protein, 11 aa, Artificial Sequence [sequence omitted]

SEQ ID NO: 3558 - protein, 11 aa, Artificial Sequence
  Made in Lab - CRDL3 from anti-Fzd VL chain
CQQSHRLPWTF

SEQ ID NO: 3559 - protein, 11 aa, Artificial Sequence [sequence omitted]

SEQ ID NO: 3560 - protein, 11 aa, Artificial Sequence [sequence omitted]

SEQ ID NO: 3561 - protein, 11 aa, Artificial Sequence [sequence omitted]

SEQ ID NO: 3562 - protein, 11 aa, Artificial Sequence
  Made in Lab - CRDL3 from anti-Fzd VL chain
CMQSLQNPITF

SEQ ID NO: 3563 - protein, 11 aa, Artificial Sequence [sequence omitted]

SEQ ID NO: 3564 - protein, 11 aa, Artificial Sequence [sequence omitted]

SEQ ID NO: 3565 - protein, 11 aa, Artificial Sequence [sequence omitted]

SEQ ID NO: 3566 - protein, 11 aa, Artificial Sequence [sequence omitted]

SEQ ID NO: 3567 - protein, 11 aa, Artificial Sequence
  Made in Lab - CRDL3 from anti-Fzd VL chain
CMQSLQNPITF

SEQ ID NO: 3568 - protein, 11 aa, Artificial Sequence [sequence omitted]

SEQ ID NO: 3569 - protein, 11 aa, Artificial Sequence
  Made in Lab - CRDL3 from anti-Fzd VL chain
CQQSHRLPWTF

SEQ ID NO: 3570 - protein, 11 aa, Artificial Sequence [sequence omitted]

SEQ ID NO: 3571 - protein, 11 aa, Artificial Sequence [sequence omitted]

SEQ ID NO: 3572 - protein, 11 aa, Artificial Sequence [sequence omitted]

SEQ ID NO: 3573 - protein, 11 aa, Artificial Sequence [sequence omitted]

SEQ ID NO: 3574 - protein, 11 aa, Artificial Sequence
  Made in Lab - CRDL3 from anti-Fzd VL chain
CQQSHRLPWTF

SEQ ID NO: 3575 - protein, 11 aa, Artificial Sequence [sequence omitted]

SEQ ID NO: 3576 - protein, 11 aa, Artificial Sequence [sequence omitted]

SEQ ID NO: 3577 - protein, 11 aa, Artificial Sequence [sequence omitted]

SEQ ID NO: 3578 - protein, 11 aa, Artificial Sequence
  Made in Lab - CRDL3 from anti-Fzd VL chain
CLQSFSSPWTF

SEQ ID NO: 3579 - protein, 11 aa, Artificial Sequence [sequence omitted]

SEQ ID NO: 3580 - protein, 11 aa, Artificial Sequence [sequence omitted]

SEQ ID NO: 3581 - protein, 11 aa, Artificial Sequence [sequence omitted]

SEQ ID NO: 3582 - protein, 11 aa, Artificial Sequence [sequence omitted]

SEQ ID NO: 3583 - protein, 11 aa, Artificial Sequence
  Made in Lab - CRDL3 from anti-Fzd VL chain
CQQSHRLPWTF

SEQ ID NO: 3584 - protein, 11 aa, Artificial Sequence [sequence omitted]

SEQ ID NO: 3585 - protein, 11 aa, Artificial Sequence [sequence omitted]

SEQ ID NO: 3586 - protein, 11 aa, Artificial Sequence [sequence omitted]

SEQ ID NO: 3587 - protein, 11 aa, Artificial Sequence [sequence omitted]

SEQ ID NO: 3588 - protein, 11 aa, Artificial Sequence [sequence omitted]

SEQ ID NO: 3589 - protein, 11 aa, Artificial Sequence [sequence omitted]

SEQ ID NO: 3590 - protein, 11 aa, Artificial Sequence [sequence omitted]

SEQ ID NO: 3591 - protein, 11 aa, Artificial Sequence
  Made in Lab - CRDL3 from anti-Fzd VL chain
CMQALEIPVTF

SEQ ID NO: 3592 - protein, 11 aa, Artificial Sequence [sequence omitted]

SEQ ID NO: 3593 - protein, 11 aa, Artificial Sequence
  Made in Lab - CRDL3 from anti-Fzd VL chain
CMQSLQNPITF

SEQ ID NO: 3594 - protein, 11 aa, Artificial Sequence [sequence omitted]

SEQ ID NO: 3595 - protein, 11 aa, Artificial Sequence
  Made in Lab - CRDL3 from anti-Fzd VL chain
CQQYGSLPIAF

SEQ ID NO: 3596 - protein, 11 aa, Artificial Sequence [sequence omitted]

SEQ ID NO: 3597 - protein, 11 aa, Artificial Sequence [sequence omitted]

SEQ ID NO: 3598 - protein, 11 aa, Artificial Sequence [sequence omitted]

SEQ ID NO: 3599 - protein, 11 aa, Artificial Sequence [sequence omitted]

SEQ ID NO: 3600 - protein, 11 aa, Artificial Sequence [sequence omitted]

SEQ ID NO: 3601 - protein, 11 aa, Artificial Sequence [sequence omitted]

SEQ ID NO: 3602 - protein, 11 aa, Artificial Sequence [sequence omitted]

SEQ ID NO: 3603 - protein, 11 aa, Artificial Sequence [sequence omitted]

SEQ ID NO: 3604 - protein, 13 aa, Artificial Sequence [sequence omitted]

SEQ ID NO: 3605 - protein, 11 aa, Artificial Sequence [sequence omitted]

SEQ ID NO: 3606 - protein, 11 aa, Artificial Sequence [sequence omitted]

SEQ ID NO: 3607 - protein, 11 aa, Artificial Sequence [sequence omitted]

SEQ ID NO: 3608 - protein, 11 aa, Artificial Sequence [sequence omitted]

SEQ ID NO: 3609 - protein, 11 aa, Artificial Sequence
  Made in Lab - CRDL3 from anti-Fzd VL chain
CQQSYSTPPTF

SEQ ID NO: 3610 - protein, 11 aa, Artificial Sequence
  Made in Lab - CRDL3 from anti-Fzd VL chain
CQQANTSPITF

SEQ ID NO: 3611 - protein, 11 aa, Artificial Sequence [sequence omitted]

SEQ ID NO: 3612 - protein, 11 aa, Artificial Sequence
  Made in Lab - CRDL3 from anti-Fzd VL chain
CQQYFSSPITF

SEQ ID NO: 3613 - protein, 11 aa, Artificial Sequence [sequence omitted]

SEQ ID NO: 3614 - protein, 11 aa, Artificial Sequence [sequence omitted]

SEQ ID NO: 3615 - protein, 11 aa, Artificial Sequence [sequence omitted]

SEQ ID NO: 3616 - protein, 11 aa, Artificial Sequence
  Made in Lab - CRDL3 from anti-Fzd VL chain
CQQSHSSPVTF

SEQ ID NO: 3617 - protein, 11 aa, Artificial Sequence [sequence omitted]

SEQ ID NO: 3618 - protein, 11 aa, Artificial Sequence [sequence omitted]

SEQ ID NO: 3619 - protein, 11 aa, Artificial Sequence [sequence omitted]

SEQ ID NO: 3620 - protein, 11 aa, Artificial Sequence [sequence omitted]

SEQ ID NO: 3621 - protein, 11 aa, Artificial Sequence [sequence omitted]

SEQ ID NO: 3622 - protein, 11 aa, Artificial Sequence
  Made in Lab - CRDL3 from anti-Fzd VL chain
CMQSLQAPITF

SEQ ID NO: 3623 - protein, 11 aa, Artificial Sequence [sequence omitted]

SEQ ID NO: 3624 - protein, 11 aa, Artificial Sequence [sequence omitted]

SEQ ID NO: 3625 - protein, 11 aa, Artificial Sequence
  Made in Lab - CRDL3 from anti-Fzd VL chain
CQQTYRNPITF

SEQ ID NO: 3626 - protein, 11 aa, Artificial Sequence [sequence omitted]

SEQ ID NO: 3627 - protein, 11 aa, Artificial Sequence [sequence omitted]

SEQ ID NO: 3628 - protein, 11 aa, Artificial Sequence [sequence omitted]

SEQ ID NO: 3629 - protein, 10 aa, Artificial Sequence
  Made in Lab - CRDL3 from anti-Fzd VL chain
CQQSYRTVTF

SEQ ID NO: 3630 - protein, 11 aa, Artificial Sequence [sequence omitted]

SEQ ID NO: 3631 - protein, 11 aa, Artificial Sequence [sequence omitted]

SEQ ID NO: 3632 - protein, 11 aa, Artificial Sequence [sequence omitted]

SEQ ID NO: 3633 - protein, 11 aa, Artificial Sequence
  Made in Lab - CRDL3 from anti-Fzd VL chain
CQQSYSYPITF

SEQ ID NO: 3634 - protein, 11 aa, Artificial Sequence
  Made in Lab - CRDL3 from anti-Fzd VL chain
CQQTWGPPFTF

SEQ ID NO: 3635 - protein, 11 aa, Artificial Sequence [sequence omitted]

SEQ ID NO: 3636 - protein, 11 aa, Artificial Sequence
  Made in Lab - CRDL3 from anti-Fzd VL chain
CQQTYATPPTF

SEQ ID NO: 3637 - protein, 11 aa, Artificial Sequence [sequence omitted]

SEQ ID NO: 3638 - protein, 11 aa, Artificial Sequence [sequence omitted]

SEQ ID NO: 3639 - protein, 11 aa, Artificial Sequence [sequence omitted]

SEQ ID NO: 3640 - protein, 11 aa, Artificial Sequence [sequence omitted]

SEQ ID NO: 3641 - protein, 11 aa, Artificial Sequence [sequence omitted]

SEQ ID NO: 3642 - protein, 11 aa, Artificial Sequence [sequence omitted]

SEQ ID NO: 3643 - protein, 11 aa, Artificial Sequence
  Made in Lab - CRDL3 from anti-Fzd VL chain
CHQYGNFPLTF

SEQ ID NO: 3644 - protein, 11 aa, Artificial Sequence [sequence omitted]

SEQ ID NO: 3645 - protein, 11 aa, Artificial Sequence [sequence omitted]

SEQ ID NO: 3646 - protein, 11 aa, Artificial Sequence [sequence omitted]

SEQ ID NO: 3647 - protein, 11 aa, Artificial Sequence [sequence omitted]

SEQ ID NO: 3648 - protein, 11 aa, Artificial Sequence [sequence omitted]

SEQ ID NO: 3649 - protein, 11 aa, Artificial Sequence [sequence omitted]

SEQ ID NO: 3650 - protein, 11 aa, Artificial Sequence [sequence omitted]

SEQ ID NO: 3651 - protein, 11 aa, Artificial Sequence [sequence omitted]

SEQ ID NO: 3652 - protein, 10 aa, Artificial Sequence [sequence omitted]

SEQ ID NO: 3653 - protein, 11 aa, Artificial Sequence [sequence omitted]

SEQ ID NO: 3654 - protein, 11 aa, Artificial Sequence
  Made in Lab - CRDL3 from anti-Fzd VL chain
CQQGYSAPFTF

SEQ ID NO: 3655 - protein, 11 aa, Artificial Sequence [sequence omitted]

SEQ ID NO: 3656 - protein, 11 aa, Artificial Sequence [sequence omitted]

SEQ ID NO: 3657 - protein, 11 aa, Artificial Sequence [sequence omitted]

SEQ ID NO: 3658 - protein, 11 aa, Artificial Sequence
  Made in Lab - CRDL3 from anti-Fzd VL chain
CQRADSFPLTF

SEQ ID NO: 3659 - protein, 11 aa, Artificial Sequence [sequence omitted]

SEQ ID NO: 3660 - protein, 11 aa, Artificial Sequence [sequence omitted]

SEQ ID NO: 3661 - protein, 11 aa, Artificial Sequence [sequence omitted]

SEQ ID NO: 3662 - protein, 11 aa, Artificial Sequence [sequence omitted]

SEQ ID NO: 3663 - protein, 11 aa, Artificial Sequence
  Made in Lab - CRDL3 from anti-Fzd VL chain
CQQNYSFPFTF

SEQ ID NO: 3664 - protein, 11 aa, Artificial Sequence
  Made in Lab - CRDL3 from anti-Fzd VL chain
CQQYGHLPVSF

SEQ ID NO: 3665 - protein, 11 aa, Artificial Sequence [sequence omitted]

SEQ ID NO: 3666 - protein, 11 aa, Artificial Sequence [sequence omitted]

SEQ ID NO: 3667 - protein, 11 aa, Artificial Sequence [sequence omitted]

SEQ ID NO: 3668 - protein, 11 aa, Artificial Sequence [sequence omitted]

SEQ ID NO: 3669 - protein, 11 aa, Artificial Sequence [sequence omitted]

SEQ ID NO: 3670 - protein, 11 aa, Artificial Sequence [sequence omitted]

SEQ ID NO: 3671 - protein, 11 aa, Artificial Sequence [sequence omitted]

SEQ ID NO: 3672 - protein, 11 aa, Artificial Sequence [sequence omitted]

SEQ ID NO: 3673 - protein, 10 aa, Artificial Sequence [sequence omitted]

SEQ ID NO: 3674 - protein, 11 aa, Artificial Sequence
  Made in Lab - CRDL3 from anti-Fzd VL chain
CQQADRLPLTF

SEQ ID NO: 3675 - protein, 11 aa, Artificial Sequence [sequence omitted]

SEQ ID NO: 3676 - protein, 11 aa, Artificial Sequence [sequence omitted]

SEQ ID NO: 3677 - protein, 11 aa, Artificial Sequence [sequence omitted]

SEQ ID NO: 3678 - protein, 11 aa, Artificial Sequence [sequence omitted]

SEQ ID NO: 3679 - protein, 11 aa, Artificial Sequence [sequence omitted]

SEQ ID NO: 3680 - protein, 11 aa, Artificial Sequence [sequence omitted]

SEQ ID NO: 3681 - protein, 11 aa, Artificial Sequence
  Made in Lab - CRDL3 from anti-Fzd VL chain
CQQSYSTPPTF

SEQ ID NO: 3682 - protein, 11 aa, Artificial Sequence [sequence omitted]

SEQ ID NO: 3683 - protein, 11 aa, Artificial Sequence [sequence omitted]

SEQ ID NO: 3684 - protein, 11 aa, Artificial Sequence [sequence omitted]

SEQ ID NO: 3685 - protein, 11 aa, Artificial Sequence [sequence omitted]

SEQ ID NO: 3686 - protein, 11 aa, Artificial Sequence [sequence omitted]

SEQ ID NO: 3687 - protein, 11 aa, Artificial Sequence [sequence omitted]

SEQ ID NO: 3688 - protein, 11 aa, Artificial Sequence [sequence omitted]

SEQ ID NO: 3689 - protein, 11 aa, Artificial Sequence [sequence omitted]

SEQ ID NO: 3690 - protein, 11 aa, Artificial Sequence
  Made in Lab - CRDL3 from anti-Fzd VL chain
CQQSDSPPVTF

SEQ ID NO: 3691 - protein, 11 aa, Artificial Sequence [sequence omitted]

SEQ ID NO: 3692 - protein, 11 aa, Artificial Sequence [sequence omitted]

SEQ ID NO: 3693 - protein, 10 aa, Artificial Sequence [sequence omitted]

SEQ ID NO: 3694 - protein, 11 aa, Artificial Sequence [sequence omitted]

SEQ ID NO: 3695 - protein, 11 aa, Artificial Sequence [sequence omitted]

SEQ ID NO: 3696 - protein, 11 aa, Artificial Sequence [sequence omitted]

SEQ ID NO: 3697 - protein, 11 aa, Artificial Sequence [sequence omitted]

SEQ ID NO: 3698 - protein, 10 aa, Artificial Sequence [sequence omitted]

SEQ ID NO: 3699 - protein, 11 aa, Artificial Sequence [sequence omitted]

SEQ ID NO: 3700 - protein, 11 aa, Artificial Sequence [sequence omitted]

SEQ ID NO: 3701 - protein, 11 aa, Artificial Sequence [sequence omitted]

SEQ ID NO: 3702 - protein, 11 aa, Artificial Sequence
  Made in Lab - CRDL3 from anti-Fzd VL chain
CQESYTTPFTF

SEQ ID NO: 3703 - protein, 11 aa, Artificial Sequence [sequence omitted]

SEQ ID NO: 3704 - protein, 11 aa, Artificial Sequence [sequence omitted]

SEQ ID NO: 3705 - protein, 11 aa, Artificial Sequence [sequence omitted]

SEQ ID NO: 3706 - protein, 11 aa, Artificial Sequence [sequence omitted]

SEQ ID NO: 3707 - protein, 13 aa, Artificial Sequence [sequence omitted]

SEQ ID NO: 3708 - protein, 11 aa, Artificial Sequence [sequence omitted]

SEQ ID NO: 3709 - protein, 11 aa, Artificial Sequence
  Made in Lab - CRDL3 from anti-Fzd VL chain
CQQSYKSPLTF

SEQ ID NO: 3710 - protein, 10 aa, Artificial Sequence [sequence omitted]

SEQ ID NO: 3711 - protein, 11 aa, Artificial Sequence
  Made in Lab - CRDL3 from anti-Fzd VL chain
CQQGYNPPRTF

SEQ ID NO: 3712 - protein, 11 aa, Artificial Sequence [sequence omitted]

SEQ ID NO: 3713 - protein, 11 aa, Artificial Sequence
  Made in Lab - CRDL3 from anti-Fzd VL chain
CQQSYTLPITF

SEQ ID NO: 3714 - protein, 11 aa, Artificial Sequence [sequence omitted]

SEQ ID NO: 3715 - protein, 11 aa, Artificial Sequence [sequence omitted]

SEQ ID NO: 3716 - protein, 11 aa, Artificial Sequence [sequence omitted]

SEQ ID NO: 3717 - protein, 11 aa, Artificial Sequence [sequence omitted]

SEQ ID NO: 3718 - protein, 11 aa, Artificial Sequence [sequence omitted]

SEQ ID NO: 3719 - protein, 11 aa, Artificial Sequence
  Made in Lab - CRDL3 from anti-Fzd VL chain
CMQAIQIPYSF

SEQ ID NO: 3720 - protein, 11 aa, Artificial Sequence [sequence omitted]

SEQ ID NO: 3721 - protein, 11 aa, Artificial Sequence [sequence omitted]

SEQ ID NO: 3722 - protein, 11 aa, Artificial Sequence [sequence omitted]

SEQ ID NO: 3723 - protein, 11 aa, Artificial Sequence
  Made in Lab - CRDL3 from anti-Fzd VL chain
CMQALRTPVTF

SEQ ID NO: 3724 - protein, 11 aa, Artificial Sequence [sequence omitted]

SEQ ID NO: 3725 - protein, 11 aa, Artificial Sequence [sequence omitted]

SEQ ID NO: 3726 - protein, 11 aa, Artificial Sequence
  Made in Lab - CRDL3 from anti-Fzd VL chain
CKQANQTPITF

SEQ ID NO: 3727 - protein, 11 aa, Artificial Sequence
  Made in Lab - CRDL3 from anti-Fzd VL chain
CKQGDQIPPTF

SEQ ID NO: 3728 - protein, 11 aa, Artificial Sequence [sequence omitted]

SEQ ID NO: 3729 - protein, 11 aa, Artificial Sequence
  Made in Lab - CRDL3 from anti-Fzd VL chain
CQQSYSEVLTF

SEQ ID NO: 3730 - protein, 11 aa, Artificial Sequence [sequence omitted]

SEQ ID NO: 3731 - protein, 11 aa, Artificial Sequence [sequence omitted]

SEQ ID NO: 3732 - protein, 11 aa, Artificial Sequence [sequence omitted]

SEQ ID NO: 3733 - protein, 11 aa, Artificial Sequence [sequence omitted]

SEQ ID NO: 3734 - protein, 11 aa, Artificial Sequence [sequence omitted]

SEQ ID NO: 3735 - protein, 11 aa, Artificial Sequence [sequence omitted]

SEQ ID NO: 3736 - protein, 11 aa, Artificial Sequence
  Made in Lab - CRDL3 from anti-Fzd VL chain
CQQTYHTPWTF

SEQ ID NO: 3737 - protein, 11 aa, Artificial Sequence [sequence omitted]

SEQ ID NO: 3738 - protein, 11 aa, Artificial Sequence [sequence omitted]

SEQ ID NO: 3739 - protein, 11 aa, Artificial Sequence [sequence omitted]

SEQ ID NO: 3740 - protein, 11 aa, Artificial Sequence [sequence omitted]

SEQ ID NO: 3741 - protein, 10 aa, Artificial Sequence
  Made in Lab - CRDL3 from anti-Fzd VL chain
CARDGSLDYW

SEQ ID NO: 3742 - protein, 11 aa, Artificial Sequence [sequence omitted]

SEQ ID NO: 3743 - protein, 11 aa, Artificial Sequence [sequence omitted]

SEQ ID NO: 3744 - protein, 11 aa, Artificial Sequence [sequence omitted]

SEQ ID NO: 3745 - protein, 11 aa, Artificial Sequence [sequence omitted]

SEQ ID NO: 3746 - protein, 11 aa, Artificial Sequence [sequence omitted]

SEQ ID NO: 3747 - protein, 11 aa, Artificial Sequence [sequence omitted]

SEQ ID NO: 3748 - protein, 11 aa, Artificial Sequence [sequence omitted]

SEQ ID NO: 3749 - protein, 11 aa, Artificial Sequence [sequence omitted]

SEQ ID NO: 3750 - protein, 11 aa, Artificial Sequence [sequence omitted]

SEQ ID NO: 3751 - protein, 11 aa, Artificial Sequence
  Made in Lab - CRDL3 from anti-Fzd VL chain
CMQALQAPTTF

SEQ ID NO: 3752 - protein, 11 aa, Artificial Sequence [sequence omitted]

SEQ ID NO: 3753 - protein, 11 aa, Artificial Sequence [sequence omitted]

SEQ ID NO: 3754 - protein, 11 aa, Artificial Sequence [sequence omitted]

SEQ ID NO: 3755 - protein, 11 aa, Artificial Sequence [sequence omitted]

SEQ ID NO: 3756 - protein, 11 aa, Artificial Sequence [sequence omitted]

SEQ ID NO: 3757 - protein, 11 aa, Artificial Sequence [sequence omitted]

SEQ ID NO: 3758 - protein, 11 aa, Artificial Sequence [sequence omitted]

SEQ ID NO: 3759 - protein, 11 aa, Artificial Sequence
  Made in Lab - CRDL3 from anti-Fzd VL chain
CQQAYSFPWTF

SEQ ID NO: 3760 - protein, 11 aa, Artificial Sequence [sequence omitted]

SEQ ID NO: 3761 - protein, 11 aa, Artificial Sequence [sequence omitted]

SEQ ID NO: 3762 - protein, 11 aa, Artificial Sequence [sequence omitted]

SEQ ID NO: 3763 - protein, 11 aa, Artificial Sequence [sequence omitted]

SEQ ID NO: 3764 - protein, 11 aa, Artificial Sequence [sequence omitted]

SEQ ID NO: 3765 - protein, 11 aa, Artificial Sequence [sequence omitted]

SEQ ID NO: 3766 - protein, 11 aa, Artificial Sequence [sequence omitted]

SEQ ID NO: 3767 - protein, 11 aa, Artificial Sequence
  Made in Lab - CRDL3 from anti-Fzd VL chain
CMQALHTPNTF

SEQ ID NO: 3768 - protein, 11 aa, Artificial Sequence [sequence omitted]

SEQ ID NO: 3769 - protein, 11 aa, Artificial Sequence [sequence omitted]

SEQ ID NO: 3770 - protein, 11 aa, Artificial Sequence [sequence omitted]

SEQ ID NO: 3771 - protein, 11 aa, Artificial Sequence [sequence omitted]

SEQ ID NO: 3772 - protein, 11 aa, Artificial Sequence [sequence omitted]

SEQ ID NO: 3773 - protein, 11 aa, Artificial Sequence [sequence omitted]

SEQ ID NO: 3774 - protein, 11 aa, Artificial Sequence [sequence omitted]

SEQ ID NO: 3775 - protein, 11 aa, Artificial Sequence [sequence omitted]

SEQ ID NO: 3776 - protein, 11 aa, Artificial Sequence [sequence omitted]

SEQ ID NO: 3777 - protein, 11 aa, Artificial Sequence [sequence omitted]

SEQ ID NO: 3778 - protein, 11 aa, Artificial Sequence [sequence omitted]

SEQ ID NO: 3779 - protein, 11 aa, Artificial Sequence [sequence omitted]

SEQ ID NO: 3780 - protein, 11 aa, Artificial Sequence [sequence omitted]

SEQ ID NO: 3781 - protein, 11 aa, Artificial Sequence [sequence omitted]

SEQ ID NO: 3782 - protein, 11 aa, Artificial Sequence [sequence omitted]

SEQ ID NO: 3783 - protein, 11 aa, Artificial Sequence [sequence omitted]

SEQ ID NO: 3784 - protein, 11 aa, Artificial Sequence
  Made in Lab - CRDL3 from anti-Fzd VL chain
CQQTYSMPLTF

SEQ ID NO: 3785 - protein, 11 aa, Artificial Sequence [sequence omitted]

SEQ ID NO: 3786 - protein, 11 aa, Artificial Sequence [sequence omitted]

SEQ ID NO: 3787 - protein, 11 aa, Artificial Sequence [sequence omitted]

SEQ ID NO: 3788 - protein, 11 aa, Artificial Sequence [sequence omitted]

SEQ ID NO: 3789 - protein, 11 aa, Artificial Sequence
  Made in Lab - CRDL3 from anti-Fzd VL chain
CMQSFQTPFTF

SEQ ID NO: 3790 - protein, 11 aa, Artificial Sequence [sequence omitted]

SEQ ID NO: 3791 - protein, 11 aa, Artificial Sequence [sequence omitted]

SEQ ID NO: 3792 - protein, 11 aa, Artificial Sequence [sequence omitted]

SEQ ID NO: 3793 - protein, 11 aa, Artificial Sequence [sequence omitted]

SEQ ID NO: 3794 - protein, 11 aa, Artificial Sequence [sequence omitted]

SEQ ID NO: 3795 - protein, 11 aa, Artificial Sequence [sequence omitted]

SEQ ID NO: 3796 - protein, 11 aa, Artificial Sequence [sequence omitted]

SEQ ID NO: 3797 - protein, 11 aa, Artificial Sequence
  Made in Lab - CRDL3 from anti-Fzd VL chain
CMQGTQRPLTF

SEQ ID NO: 3798 - protein, 11 aa, Artificial Sequence [sequence omitted]

SEQ ID NO: 3799 - protein, 11 aa, Artificial Sequence [sequence omitted]

SEQ ID NO: 3800 - protein, 11 aa, Artificial Sequence
  Made in Lab - CRDL3 from anti-Fzd VL chain
CMQVLQPPYTF

SEQ ID NO: 3801 - protein, 11 aa, Artificial Sequence [sequence omitted]

SEQ ID NO: 3802 - protein, 11 aa, Artificial Sequence [sequence omitted]

SEQ ID NO: 3803 - protein, 11 aa, Artificial Sequence [sequence omitted]

SEQ ID NO: 3804 - protein, 11 aa, Artificial Sequence [sequence omitted]

SEQ ID NO: 3805 - protein, 11 aa, Artificial Sequence
  Made in Lab - CRDL3 from anti-Fzd VL chain
CQQIHSYPLTF

SEQ ID NO: 3806 - protein, 11 aa, Artificial Sequence [sequence omitted]

SEQ ID NO: 3807 - protein, 11 aa, Artificial Sequence [sequence omitted]

SEQ ID NO: 3808 - protein, 11 aa, Artificial Sequence [sequence omitted]

SEQ ID NO: 3809 - protein, 11 aa, Artificial Sequence [sequence omitted]

SEQ ID NO: 3810 - protein, 11 aa, Artificial Sequence [sequence omitted]

SEQ ID NO: 3811 - protein, 11 aa, Artificial Sequence [sequence omitted]

SEQ ID NO: 3812 - protein, 11 aa, Artificial Sequence [sequence omitted]

SEQ ID NO: 3813 - protein, 11 aa, Artificial Sequence [sequence omitted]

SEQ ID NO: 3814 - protein, 11 aa, Artificial Sequence
  Made in Lab - CRDL3 from anti-Fzd VL chain
CHQYYSLPITF

SEQ ID NO: 3815 - protein, 11 aa, Artificial Sequence [sequence omitted]

SEQ ID NO: 3816 - protein, 11 aa, Artificial Sequence [sequence omitted]

SEQ ID NO: 3817 - protein, 11 aa, Artificial Sequence [sequence omitted]

SEQ ID NO: 3818 - protein, 11 aa, Artificial Sequence [sequence omitted]

SEQ ID NO: 3819 - protein, 11 aa, Artificial Sequence [sequence omitted]

SEQ ID NO: 3820 - protein, 11 aa, Artificial Sequence [sequence omitted]

SEQ ID NO: 3821 - protein, 11 aa, Artificial Sequence [sequence omitted]

SEQ ID NO: 3822 - protein, 11 aa, Artificial Sequence [sequence omitted]

SEQ ID NO: 3823 - protein, 11 aa, Artificial Sequence
  Made in Lab - CRDL3 from anti-Fzd VL chain
CQQSSRTPPTF

SEQ ID NO: 3824 - protein, 11 aa, Artificial Sequence [sequence omitted]

SEQ ID NO: 3825 - protein, 10 aa, Artificial Sequence
  Made in Lab - CRDL3 from anti-Fzd VL chain
CQQYGNLITF

SEQ ID NO: 3826 - protein, 11 aa, Artificial Sequence [sequence omitted]

SEQ ID NO: 3827 - protein, 11 aa, Artificial Sequence [sequence omitted]

SEQ ID NO: 3828 - protein, 11 aa, Artificial Sequence [sequence omitted]

SEQ ID NO: 3829 - protein, 11 aa, Artificial Sequence [sequence omitted]

SEQ ID NO: 3830 - protein, 11 aa, Artificial Sequence [sequence omitted]

SEQ ID NO: 3831 - protein, 11 aa, Artificial Sequence
  Made in Lab - CRDL3 from anti-Fzd VL chain
CQQSASPPPTF

SEQ ID NO: 3832 - protein, 11 aa, Artificial Sequence [sequence omitted]

SEQ ID NO: 3833 - protein, 11 aa, Artificial Sequence [sequence omitted]

SEQ ID NO: 3834 - protein, 11 aa, Artificial Sequence
  Made in Lab - CRDL3 from anti-Fzd VL chain
CEQSYSTPLTF

SEQ ID NO: 3835 - protein, 11 aa, Artificial Sequence [sequence omitted]

SEQ ID NO: 3836 - protein, 11 aa, Artificial Sequence [sequence omitted]

SEQ ID NO: 3837 - protein, 11 aa, Artificial Sequence
  Made in Lab - CRDL3 from anti-Fzd VL chain
CMQSRHWPLTF

SEQ ID NO: 3838 - protein, 11 aa, Artificial Sequence [sequence omitted]

SEQ ID NO: 3839 - protein, 11 aa, Artificial Sequence [sequence omitted]

SEQ ID NO: 3840 - protein, 11 aa, Artificial Sequence [sequence omitted]

SEQ ID NO: 3841 - protein, 11 aa, Artificial Sequence
  Made in Lab - CRDL3 from anti-Fzd VL chain
CQQTYAIPLTF

SEQ ID NO: 3842 - protein, 11 aa, Artificial Sequence [sequence omitted]

SEQ ID NO: 3843 - protein, 11 aa, Artificial Sequence [sequence omitted]

SEQ ID NO: 3844 - protein, 11 aa, Artificial Sequence [sequence omitted]

SEQ ID NO: 3845 - protein, 11 aa, Artificial Sequence [sequence omitted]

SEQ ID NO: 3846 - protein, 11 aa, Artificial Sequence [sequence omitted]

SEQ ID NO: 3847 - protein, 11 aa, Artificial Sequence [sequence omitted]

SEQ ID NO: 3848 - protein, 11 aa, Artificial Sequence [sequence omitted]

SEQ ID NO: 3849 - protein, 11 aa, Artificial Sequence [sequence omitted]

SEQ ID NO: 3850 - protein, 11 aa, Artificial Sequence [sequence omitted]

SEQ ID NO: 3851 - protein, 11 aa, Artificial Sequence [sequence omitted]

SEQ ID NO: 3852 - protein, 11 aa, Artificial Sequence [sequence omitted]

SEQ ID NO: 3853 - protein, 11 aa, Artificial Sequence
  Made in Lab - CRDL3 from anti-Fzd VL chain
CQQSFNGPLTF

SEQ ID NO: 3854 - protein, 11 aa, Artificial Sequence [sequence omitted]

SEQ ID NO: 3855 - protein, 11 aa, Artificial Sequence [sequence omitted]

SEQ ID NO: 3856 - protein, 11 aa, Artificial Sequence
  Made in Lab - CRDL3 from anti-Fzd VL chain
CQQSYSTPPTF

SEQ ID NO: 3857 - protein, 11 aa, Artificial Sequence [sequence omitted]

SEQ ID NO: 3858 - protein, 11 aa, Artificial Sequence [sequence omitted]

SEQ ID NO: 3859 - protein, 11 aa, Artificial Sequence [sequence omitted]

SEQ ID NO: 3860 - protein, 11 aa, Artificial Sequence
  Made in Lab - CRDL3 from anti-Fzd VL chain
CQQYDRYPYIF

SEQ ID NO: 3861 - protein, 11 aa, Artificial Sequence [sequence omitted]

SEQ ID NO: 3862 - protein, 11 aa, Artificial Sequence [sequence omitted]

SEQ ID NO: 3863 - protein, 11 aa, Artificial Sequence
  Made in Lab - CRDL3 from anti-Fzd VL chain
CQQSYRIPFSF

SEQ ID NO: 3864 - protein, 11 aa, Artificial Sequence [sequence omitted]

SEQ ID NO: 3865 - protein, 11 aa, Artificial Sequence [sequence omitted]

SEQ ID NO: 3866 - protein, 11 aa, Artificial Sequence [sequence omitted]

SEQ ID NO: 3867 - protein, 11 aa, Artificial Sequence [sequence omitted]

SEQ ID NO: 3868 - protein, 11 aa, Artificial Sequence [sequence omitted]

SEQ ID NO: 3869 - protein, 11 aa, Artificial Sequence [sequence omitted]

SEQ ID NO: 3870 - protein, 11 aa, Artificial Sequence [sequence omitted]

SEQ ID NO: 3871 - protein, 11 aa, Artificial Sequence
  Made in Lab - CRDL3 from anti-Fzd VL chain
CQQYGSLPIAF

SEQ ID NO: 3872 - protein, 11 aa, Artificial Sequence [sequence omitted]

SEQ ID NO: 3873 - protein, 11 aa, Artificial Sequence [sequence omitted]

SEQ ID NO: 3874 - protein, 11 aa, Artificial Sequence [sequence omitted]

SEQ ID NO: 3875 - protein, 11 aa, Artificial Sequence [sequence omitted]

SEQ ID NO: 3876 - protein, 11 aa, Artificial Sequence [sequence omitted]

SEQ ID NO: 3877 - protein, 11 aa, Artificial Sequence [sequence omitted]

SEQ ID NO: 3878 - protein, 11 aa, Artificial Sequence
  Made in Lab - CRDL3 from anti-Fzd VL chain
CMQHTHWPPTF

SEQ ID NO: 3879 - protein, 11 aa, Artificial Sequence [sequence omitted]

SEQ ID NO: 3880 - protein, 11 aa, Artificial Sequence [sequence omitted]

SEQ ID NO: 3881 - protein, 11 aa, Artificial Sequence [sequence omitted]

SEQ ID NO: 3882 - protein, 11 aa, Artificial Sequence [sequence omitted]

SEQ ID NO: 3883 - protein, 11 aa, Artificial Sequence
  Made in Lab - CRDL3 from anti-Fzd VL chain
CQQSFRIPPTF

SEQ ID NO: 3884 - protein, 11 aa, Artificial Sequence [sequence omitted]

SEQ ID NO: 3885 - protein, 11 aa, Artificial Sequence [sequence omitted]

SEQ ID NO: 3886 - protein, 11 aa, Artificial Sequence [sequence omitted]

SEQ ID NO: 3887 - protein, 11 aa, Artificial Sequence
  Made in Lab - CRDL3 from anti-Fzd VL chain
CMQVLQNPITF

SEQ ID NO: 3888 - protein, 11 aa, Artificial Sequence [sequence omitted]

SEQ ID NO: 3889 - protein, 11 aa, Artificial Sequence [sequence omitted]

SEQ ID NO: 3890 - protein, 11 aa, Artificial Sequence [sequence omitted]

SEQ ID NO: 3891 - protein, 11 aa, Artificial Sequence [sequence omitted]

SEQ ID NO: 3892 - protein, 11 aa, Artificial Sequence [sequence omitted]

SEQ ID NO: 3893 - protein, 11 aa, Artificial Sequence [sequence omitted]

SEQ ID NO: 3894 - protein, 11 aa, Artificial Sequence [sequence omitted]

SEQ ID NO: 3895 - protein, 11 aa, Artificial Sequence [sequence omitted]

SEQ ID NO: 3896 - protein, 11 aa, Artificial Sequence [sequence omitted]

SEQ ID NO: 3897 - protein, 11 aa, Artificial Sequence [sequence omitted]

SEQ ID NO: 3898 - protein, 11 aa, Artificial Sequence
  Made in Lab - CRDL3 from anti-Fzd VL chain
CQQANTFPPAF

SEQ ID NO: 3899 - protein, 11 aa, Artificial Sequence [sequence omitted]

SEQ ID NO: 3900 - protein, 11 aa, Artificial Sequence [sequence omitted]

SEQ ID NO: 3901 - protein, 11 aa, Artificial Sequence
  Made in Lab - CRDL3 from anti-Fzd VL chain
CQQSFAPPRTF

SEQ ID NO: 3902 - protein, 11 aa, Artificial Sequence [sequence omitted]

SEQ ID NO: 3903 - protein, 11 aa, Artificial Sequence [sequence omitted]

SEQ ID NO: 3904 - protein, 11 aa, Artificial Sequence [sequence omitted]

SEQ ID NO: 3905 - protein, 11 aa, Artificial Sequence [sequence omitted]

SEQ ID NO: 3906 - protein, 11 aa, Artificial Sequence [sequence omitted]

SEQ ID NO: 3907 - protein, 11 aa, Artificial Sequence [sequence omitted]

SEQ ID NO: 3908 - protein, 11 aa, Artificial Sequence
  Made in Lab - CRDL3 from anti-Fzd VL chain
CQSYDRNSLVF

SEQ ID NO: 3909 - protein, 11 aa, Artificial Sequence [sequence omitted]

SEQ ID NO: 3910 - protein, 13 aa, Artificial Sequence [sequence omitted]

SEQ ID NO: 3911 - protein, 11 aa, Artificial Sequence
  Made in Lab - CRDL3 from anti-Fzd VL chain
CQSYDRNSLVF

SEQ ID NO: 3912 - protein, 11 aa, Artificial Sequence [sequence omitted]

SEQ ID NO: 3913 - protein, 13 aa, Artificial Sequence [sequence omitted]

SEQ ID NO: 3914 - protein, 13 aa, Artificial Sequence
  Made in Lab - CRDL3 from anti-Fzd VL chain
CSAWDSSLTVQVF

SEQ ID NO: 3915 - protein, 13 aa, Artificial Sequence [sequence omitted]

SEQ ID NO: 3916 - protein, 11 aa, Artificial Sequence [sequence omitted]

SEQ ID NO: 3917 - protein, 11 aa, Artificial Sequence [sequence omitted]

SEQ ID NO: 3918 - protein, 13 aa, Artificial Sequence
  Made in Lab - CRDL3 from anti-Fzd VL chain
CSAWDSSLSVQVF

SEQ ID NO: 3919 - protein, 13 aa, Artificial Sequence
  Made in Lab - CRDL3 from anti-Fzd VL chain
CSAWDSSLTVQVF

SEQ ID NO: 3920 - protein, 13 aa, Artificial Sequence [sequence omitted]

SEQ ID NO: 3921 - protein, 12 aa, Artificial Sequence
  Made in Lab - CRDL3 from anti-Fzd VL chain
CQSYDNNYRAVF

SEQ ID NO: 3922 - protein, 14 aa, Artificial Sequence
  Made in Lab - CRDL3 from anti-Fzd VL chain
CAAWDDRFNGFALF

SEQ ID NO: 3923 - protein, 13 aa, Artificial Sequence [sequence omitted]

SEQ ID NO: 3924 - protein, 13 aa, Artificial Sequence [sequence omitted]

SEQ ID NO: 3925 - protein, 13 aa, Artificial Sequence
  Made in Lab - CRDL3 from anti-Fzd VL chain
CSAWDSSLTVQVF

SEQ ID NO: 3926 - protein, 13 aa, Artificial Sequence [sequence omitted]

SEQ ID NO: 3927 - protein, 13 aa, Artificial Sequence
  Made in Lab - CRDL3 from anti-Fzd VL chain
CSAWDSSLKVQVF

SEQ ID NO: 3928 - protein, 12 aa, Artificial Sequence
  Made in Lab - CRDL3 from anti-Fzd VL chain
CQSYDNNYRAVF

SEQ ID NO: 3929 - protein, 11 aa, Artificial Sequence [sequence omitted]

SEQ ID NO: 3930 - protein, 13 aa, Artificial Sequence
  Made in Lab - CRDL3 from anti-Fzd VL chain
CSAWDTSLRVQVF

SEQ ID NO: 3931 - protein, 13 aa, Artificial Sequence [sequence omitted]

SEQ ID NO: 3932 - protein, 13 aa, Artificial Sequence
  Made in Lab - CRDL3 from anti-Fzd VL chain
CSAWDSSLTVQVF

SEQ ID NO: 3933 - protein, 11 aa, Artificial Sequence [sequence omitted]

SEQ ID NO: 3934 - protein, 12 aa, Artificial Sequence [sequence omitted]

SEQ ID NO: 3935 - protein, 13 aa, Artificial Sequence
  Made in Lab - CRDL3 from anti-Fzd VL chain
CSAWDSSLKVQVF

SEQ ID NO: 3936 - protein, 13 aa, Artificial Sequence [sequence omitted]

SEQ ID NO: 3937 - protein, 11 aa, Artificial Sequence [sequence omitted]

SEQ ID NO: 3938 - protein, 13 aa, Artificial Sequence [sequence omitted]

SEQ ID NO: 3939 - protein, 11 aa, Artificial Sequence [sequence omitted]

SEQ ID NO: 3940 - protein, 13 aa, Artificial Sequence
  Made in Lab - CRDL3 from anti-Fzd VL chain
CSSWDNSLSAQVF

SEQ ID NO: 3941 - protein, 13 aa, Artificial Sequence
  Made in Lab - CRDL3 from anti-Fzd VL chain
CSAWDSSLKVQVF

SEQ ID NO: 3942 - protein, 13 aa, Artificial Sequence
  Made in Lab - CRDL3 from anti-Fzd VL chain
CSAWDSSLTVQVF

SEQ ID NO: 3943 - protein, 13 aa, Artificial Sequence
  Made in Lab - CRDL3 from anti-Fzd VL chain
CSAWDSSLKVQVF

SEQ ID NO: 3944 - protein, 11 aa, Artificial Sequence [sequence omitted]

SEQ ID NO: 3945 - protein, 13 aa, Artificial Sequence
  Made in Lab - CRDL3 from anti-Fzd VL chain
CSSWDNSLSAQVF

SEQ ID NO: 3946 - protein, 13 aa, Artificial Sequence
  Made in Lab - CRDL3 from anti-Fzd VL chain
CSAWDSSLKVQVF

SEQ ID NO: 3947 - protein, 11 aa, Artificial Sequence [sequence omitted]

SEQ ID NO: 3948 - protein, 13 aa, Artificial Sequence [sequence omitted]

SEQ ID NO: 3949 - protein, 13 aa, Artificial Sequence
  Made in Lab - CRDL3 from anti-Fzd VL chain
CGTWDGSLSSGVF

SEQ ID NO: 3950 - protein, 13 aa, Artificial Sequence
  Made in Lab - CRDL3 from anti-Fzd VL chain
CSAWDSSLTVQVF

SEQ ID NO: 3951 - protein, 13 aa, Artificial Sequence
  Made in Lab - CRDL3 from anti-Fzd VL chain
CSAWDSSLTVQVF

SEQ ID NO: 3952 - protein, 13 aa, Artificial Sequence
  Made in Lab - CRDL3 from anti-Fzd VL chain
CSSWDSSLKVQLF

SEQ ID NO: 3953 - protein, 11 aa, Artificial Sequence
  Made in Lab - CRDL3 from anti-Fzd VL chain
CQSYGSGFVVF

SEQ ID NO: 3954 - protein, 13 aa, Artificial Sequence
  Made in Lab - CRDL3 from anti-Fzd VL chain
CAAWDLPLNAVVF

SEQ ID NO: 3955 - protein, 13 aa, Artificial Sequence
  Made in Lab - CRDL3 from anti-Fzd VL chain
CSAWDSSLKVQVF

SEQ ID NO: 3956 - protein, 13 aa, Artificial Sequence [sequence omitted]

SEQ ID NO: 3957 - protein, 13 aa, Artificial Sequence
  Made in Lab - CRDL3 from anti-Fzd VL chain
CSAWDSSLKVQVF

SEQ ID NO: 3958 - protein, 12 aa, Artificial Sequence [sequence omitted]

SEQ ID NO: 3959 - protein, 11 aa, Artificial Sequence [sequence omitted]

SEQ ID NO: 3960 - protein, 13 aa, Artificial Sequence
  Made in Lab - CRDL3 from anti-Fzd VL chain
CSAWDSSLRVQVF

SEQ ID NO: 3961 - protein, 13 aa, Artificial Sequence
  Made in Lab - CRDL3 from anti-Fzd VL chain
CSSWDNSLSAQVF

SEQ ID NO: 3962 - protein, 11 aa, Artificial Sequence [sequence omitted]

SEQ ID NO: 3963 - protein, 13 aa, Artificial Sequence
  Made in Lab - CRDL3 from anti-Fzd VL chain
CSAWDSSLTVHVF

SEQ ID NO: 3964 - protein, 11 aa, Artificial Sequence [sequence omitted]

SEQ ID NO: 3965 - protein, 11 aa, Artificial Sequence
  Made in Lab - CRDL3 from anti-Fzd VL chain
CQSFDTSNQVF

SEQ ID NO: 3966 - protein, 13 aa, Artificial Sequence
  Made in Lab - CRDL3 from anti-Fzd VL chain
CSSWDNSLSAQVF

SEQ ID NO: 3967 - protein, 11 aa, Artificial Sequence [sequence omitted]

SEQ ID NO: 3968 - protein, 13 aa, Artificial Sequence [sequence omitted]

SEQ ID NO: 3969 - protein, 13 aa, Artificial Sequence [sequence omitted]

SEQ ID NO: 3970 - protein, 11 aa, Artificial Sequence [sequence omitted]

SEQ ID NO: 3971 - protein, 13 aa, Artificial Sequence [sequence omitted]

SEQ ID NO: 3972 - protein, 13 aa, Artificial Sequence
  Made in Lab - CRDL3 from anti-Fzd VL chain
CSAWDSSLTVQVF

SEQ ID NO: 3973 - protein, 13 aa, Artificial Sequence
  Made in Lab - CRDL3 from anti-Fzd VL chain
CSAWDSSLTVQVF

SEQ ID NO: 3974 - protein, 13 aa, Artificial Sequence
  Made in Lab - CRDL3 from anti-Fzd VL chain
CSAWDSSLKVQVF

SEQ ID NO: 3975 - protein, 13 aa, Artificial Sequence
  Made in Lab - CRDL3 from anti-Fzd VL chain
CSAWDSSLRVQVF

SEQ ID NO: 3976 - protein, 11 aa, Artificial Sequence [sequence omitted]

SEQ ID NO: 3977 - protein, 11 aa, Artificial Sequence [sequence omitted]

SEQ ID NO: 3978 - protein, 11 aa, Artificial Sequence [sequence omitted]

SEQ ID NO: 3979 - protein, 11 aa, Artificial Sequence
  Made in Lab - CRDL3 from anti-Fzd VL chain
CQQIHSYPLTF

SEQ ID NO: 3980 - protein, 11 aa, Artificial Sequence [sequence omitted]

SEQ ID NO: 3981 - protein, 11 aa, Artificial Sequence [sequence omitted]

SEQ ID NO: 3982 - protein, 11 aa, Artificial Sequence [sequence omitted]

SEQ ID NO: 3983 - protein, 11 aa, Artificial Sequence [sequence omitted]

SEQ ID NO: 3984 - protein, 11 aa, Artificial Sequence [sequence omitted]

SEQ ID NO: 3985 - protein, 11 aa, Artificial Sequence [sequence omitted]

SEQ ID NO: 3986 - protein, 11 aa, Artificial Sequence [sequence omitted]

SEQ ID NO: 3987 - protein, 11 aa, Artificial Sequence [sequence omitted]

SEQ ID NO: 3988 - protein, 11 aa, Artificial Sequence [sequence omitted]

SEQ ID NO: 3989 - protein, 11 aa, Artificial Sequence
  Made in Lab - CRDL3 from anti-Fzd VL chain
CMQAVQVPITF

SEQ ID NO: 3990 - protein, 11 aa, Artificial Sequence [sequence omitted]

SEQ ID NO: 3991 - protein, 11 aa, Artificial Sequence [sequence omitted]

SEQ ID NO: 3992 - protein, 11 aa, Artificial Sequence [sequence omitted]

SEQ ID NO: 3993 - protein, 11 aa, Artificial Sequence [sequence omitted]

SEQ ID NO: 3994 - protein, 11 aa, Artificial Sequence [sequence omitted]

SEQ ID NO: 3995 - protein, 11 aa, Artificial Sequence
  Made in Lab - CRDL3 from anti-Fzd VL chain
CQQYFTPPITF

SEQ ID NO: 3996 - protein, 11 aa, Artificial Sequence
  Made in Lab - CRDL3 from anti-Fzd VL chain
CMQSTQLPWTF

SEQ ID NO: 3997 - protein, 11 aa, Artificial Sequence [sequence omitted]

SEQ ID NO: 3998 - protein, 11 aa, Artificial Sequence [sequence omitted]

SEQ ID NO: 3999 - protein, 11 aa, Artificial Sequence [sequence omitted]

SEQ ID NO: 4000 - protein, 10 aa, Artificial Sequence [sequence omitted]

SEQ ID NO: 4001 - protein, 11 aa, Artificial Sequence [sequence omitted]

SEQ ID NO: 4002 - protein, 10 aa, Artificial Sequence [sequence omitted]

SEQ ID NO: 4003 - protein, 11 aa, Artificial Sequence [sequence omitted]

SEQ ID NO: 4004 - protein, 11 aa, Artificial Sequence [sequence omitted]

SEQ ID NO: 4005 - protein, 11 aa, Artificial Sequence [sequence omitted]

SEQ ID NO: 4006 - protein, 11 aa, Artificial Sequence [sequence omitted]

SEQ ID NO: 4007 - protein, 11 aa, Artificial Sequence [sequence omitted]

SEQ ID NO: 4008 - protein, 11 aa, Artificial Sequence [sequence omitted]

SEQ ID NO: 4009 - protein, 11 aa, Artificial Sequence [sequence omitted]

SEQ ID NO: 4010 - protein, 11 aa, Artificial Sequence [sequence omitted]

SEQ ID NO: 4011 - protein, 11 aa, Artificial Sequence [sequence omitted]

SEQ ID NO: 4012 - protein, 11 aa, Artificial Sequence [sequence omitted]

SEQ ID NO: 4013 - protein, 10 aa, Artificial Sequence
  Made in Lab - CRDL3 from anti-Fzd VL chain
CMQGRQTPTF

SEQ ID NO: 4014 - protein, 11 aa, Artificial Sequence [sequence omitted]

SEQ ID NO: 4015 - protein, 11 aa, Artificial Sequence [sequence omitted]

SEQ ID NO: 4016 - protein, 11 aa, Artificial Sequence [sequence omitted]

SEQ ID NO: 4017 - protein, 10 aa, Artificial Sequence [sequence omitted]

SEQ ID NO: 4018 - protein, 11 aa, Artificial Sequence [sequence omitted]

SEQ ID NO: 4019 - protein, 11 aa, Artificial Sequence [sequence omitted]

SEQ ID NO: 4020 - protein, 10 aa, Artificial Sequence [sequence omitted]

SEQ ID NO: 4021 - protein, 11 aa, Artificial Sequence
  Made in Lab - CRDL3 from anti-Fzd VL chain
CMQARQAPYTF

SEQ ID NO: 4022 - protein, 10 aa, Artificial Sequence [sequence omitted]

SEQ ID NO: 4023 - protein, 11 aa, Artificial Sequence [sequence omitted]

SEQ ID NO: 4024 - protein, 11 aa, Artificial Sequence [sequence omitted]

SEQ ID NO: 4025 - protein, 10 aa, Artificial Sequence [sequence omitted]

SEQ ID NO: 4026 - protein, 11 aa, Artificial Sequence [sequence omitted]

SEQ ID NO: 4027 - protein, 11 aa, Artificial Sequence [sequence omitted]

SEQ ID NO: 4028 - protein, 10 aa, Artificial Sequence [sequence omitted]

SEQ ID NO: 4029 - protein, 11 aa, Artificial Sequence [sequence omitted]

SEQ ID NO: 4030 - protein, 11 aa, Artificial Sequence [sequence omitted]

SEQ ID NO: 4031 - protein, 11 aa, Artificial Sequence [sequence omitted]

SEQ ID NO: 4032 - protein, 11 aa, Artificial Sequence [sequence omitted]

SEQ ID NO: 4033 - protein, 11 aa, Artificial Sequence [sequence omitted]

SEQ ID NO: 4034 - protein, 11 aa, Artificial Sequence [sequence omitted]

SEQ ID NO: 4035 - protein, 11 aa, Artificial Sequence [sequence omitted]

SEQ ID NO: 4036 - protein, 11 aa, Artificial Sequence [sequence omitted]

SEQ ID NO: 4037 - protein, 10 aa, Artificial Sequence [sequence omitted]

SEQ ID NO: 4038 - protein, 11 aa, Artificial Sequence
  Made in Lab - CRDL3 from anti-Fzd VL chain
CWQGTHFPYTF

SEQ ID NO: 4039 - protein, 11 aa, Artificial Sequence [sequence omitted]

SEQ ID NO: 4040 - protein, 11 aa, Artificial Sequence
  Made in Lab - CRDL3 from anti-Fzd VL chain
CAQVLQLPYTF

SEQ ID NO: 4041 - protein, 11 aa, Artificial Sequence [sequence omitted]

SEQ ID NO: 4042 - protein, 11 aa, Artificial Sequence
  Made in Lab - CRDL3 from anti-Fzd VL chain
CMQSFQPPFTF

SEQ ID NO: 4043 - protein, 11 aa, Artificial Sequence [sequence omitted]

SEQ ID NO: 4044 - protein, 11 aa, Artificial Sequence [sequence omitted]

SEQ ID NO: 4045 - protein, 11 aa, Artificial Sequence [sequence omitted]

SEQ ID NO: 4046 - protein, 11 aa, Artificial Sequence [sequence omitted]

SEQ ID NO: 4047 - protein, 11 aa, Artificial Sequence [sequence omitted]

SEQ ID NO: 4048 - protein, 11 aa, Artificial Sequence [sequence omitted]

SEQ ID NO: 4049 - protein, 11 aa, Artificial Sequence [sequence omitted]

SEQ ID NO: 4050 - protein, 11 aa, Artificial Sequence
  Made in Lab - CRDL3 from anti-Fzd VL chain
CQQCYDTPLTF

SEQ ID NO: 4051 - protein, 11 aa, Artificial Sequence [sequence omitted]

SEQ ID NO: 4052 - protein, 11 aa, Artificial Sequence [sequence omitted]

SEQ ID NO: 4053 - protein, 11 aa, Artificial Sequence [sequence omitted]

SEQ ID NO: 4054 - protein, 11 aa, Artificial Sequence [sequence omitted]

SEQ ID NO: 4055 - protein, 11 aa, Artificial Sequence [sequence omitted]

SEQ ID NO: 4056 - protein, 11 aa, Artificial Sequence
  Made in Lab - CRDL3 from anti-Fzd VL chain
CMQSLQPPFTF

SEQ ID NO: 4057 - protein, 11 aa, Artificial Sequence [sequence omitted]

SEQ ID NO: 4058 - protein, 11 aa, Artificial Sequence [sequence omitted]

SEQ ID NO: 4059 - protein, 11 aa, Artificial Sequence
  Made in Lab - CRDL3 from anti-Fzd VL chain
CQQDYNSPLTF

SEQ ID NO: 4060 - protein, 11 aa, Artificial Sequence [sequence omitted]

SEQ ID NO: 4061 - protein, 11 aa, Artificial Sequence [sequence omitted]

SEQ ID NO: 4062 - protein, 11 aa, Artificial Sequence [sequence omitted]

SEQ ID NO: 4063 - protein, 11 aa, Artificial Sequence [sequence omitted]

SEQ ID NO: 4064 - protein, 11 aa, Artificial Sequence [sequence omitted]

SEQ ID NO: 4065 - protein, 11 aa, Artificial Sequence [sequence omitted]

SEQ ID NO: 4066 - protein, 11 aa, Artificial Sequence
  Made in Lab - CRDL3 from anti-Fzd VL chain
CHQYYSVPFTF

SEQ ID NO: 4067 - protein, 11 aa, Artificial Sequence [sequence omitted]

SEQ ID NO: 4068 - protein, 11 aa, Artificial Sequence [sequence omitted]

SEQ ID NO: 4069 - protein, 11 aa, Artificial Sequence [sequence omitted]

SEQ ID NO: 4070 - protein, 11 aa, Artificial Sequence [sequence omitted]

SEQ ID NO: 4071 - protein, 11 aa, Artificial Sequence [sequence omitted]

SEQ ID NO: 4072 - protein, 11 aa, Artificial Sequence [sequence omitted]

SEQ ID NO: 4073 - protein, 11 aa, Artificial Sequence [sequence omitted]

SEQ ID NO: 4074 - protein, 11 aa, Artificial Sequence [sequence omitted]

SEQ ID NO: 4075 - protein, 11 aa, Artificial Sequence [sequence omitted]

SEQ ID NO: 4076 - protein, 11 aa, Artificial Sequence [sequence omitted]

SEQ ID NO: 4077 - protein, 11 aa, Artificial Sequence [sequence omitted]

SEQ ID NO: 4078 - protein, 11 aa, Artificial Sequence [sequence omitted]

SEQ ID NO: 4079 - protein, 11 aa, Artificial Sequence [sequence omitted]

SEQ ID NO: 4080 - protein, 11 aa, Artificial Sequence
  Made in Lab - CRDL3 from anti-Fzd VL chain
CQQAYDFPLTF

SEQ ID NO: 4081 - protein, 11 aa, Artificial Sequence [sequence omitted]

SEQ ID NO: 4082 - protein, 11 aa, Artificial Sequence [sequence omitted]

SEQ ID NO: 4083 - protein, 11 aa, Artificial Sequence [sequence omitted]

SEQ ID NO: 4084 - protein, 11 aa, Artificial Sequence [sequence omitted]

SEQ ID NO: 4085 - protein, 11 aa, Artificial Sequence [sequence omitted]

SEQ ID NO: 4086 - protein, 11 aa, Artificial Sequence [sequence omitted]

SEQ ID NO: 4087 - protein, 11 aa, Artificial Sequence [sequence omitted]

SEQ ID NO: 4088 - protein, 11 aa, Artificial Sequence [sequence omitted]

SEQ ID NO: 4089 - protein, 11 aa, Artificial Sequence [sequence omitted]

SEQ ID NO: 4090 - protein, 11 aa, Artificial Sequence [sequence omitted]

SEQ ID NO: 4091 - protein, 11 aa, Artificial Sequence
  Made in Lab - CRDL3 from anti-Fzd VL chain
CQQDYSFPITF

SEQ ID NO: 4092 - protein, 11 aa, Artificial Sequence [sequence omitted]

SEQ ID NO: 4093 - protein, 11 aa, Artificial Sequence [sequence omitted]

SEQ ID NO: 4094 - protein, 11 aa, Artificial Sequence [sequence omitted]

SEQ ID NO: 4095 - protein, 11 aa, Artificial Sequence [sequence omitted]

SEQ ID NO: 4096 - protein, 11 aa, Artificial Sequence [sequence omitted]

SEQ ID NO: 4097 - protein, 11 aa, Artificial Sequence [sequence omitted]

SEQ ID NO: 4098 - protein, 11 aa, Artificial Sequence [sequence omitted]

SEQ ID NO: 4099 - protein, 11 aa, Artificial Sequence [sequence omitted]

SEQ ID NO: 4100 - protein, 11 aa, Artificial Sequence [sequence omitted]

SEQ ID NO: 4101 - protein, 11 aa, Artificial Sequence [sequence omitted]

SEQ ID NO: 4102 - protein, 11 aa, Artificial Sequence [sequence omitted]

SEQ ID NO: 4103 - protein, 11 aa, Artificial Sequence [sequence omitted]

SEQ ID NO: 4104 - protein, 11 aa, Artificial Sequence [sequence omitted]

SEQ ID NO: 4105 - protein, 11 aa, Artificial Sequence [sequence omitted]

SEQ ID NO: 4106 - protein, 11 aa, Artificial Sequence [sequence omitted]

SEQ ID NO: 4107 - protein, 11 aa, Artificial Sequence [sequence omitted]

SEQ ID NO: 4108 - protein, 11 aa, Artificial Sequence [sequence omitted]

SEQ ID NO: 4109 - protein, 11 aa, Artificial Sequence [sequence omitted]

SEQ ID NO: 4110 - protein, 11 aa, Artificial Sequence [sequence omitted]

SEQ ID NO: 4111 - protein, 11 aa, Artificial Sequence [sequence omitted]

SEQ ID NO: 4112 - protein, 11 aa, Artificial Sequence [sequence omitted]

SEQ ID NO: 4113 - protein, 11 aa, Artificial Sequence [sequence omitted]

SEQ ID NO: 4114 - protein, 11 aa, Artificial Sequence [sequence omitted]

SEQ ID NO: 4115 - protein, 11 aa, Artificial Sequence [sequence omitted]

SEQ ID NO: 4116 - protein, 11 aa, Artificial Sequence
  Made in Lab - CRDL3 from anti-Fzd VL chain
CMQGLQPPFTF

SEQ ID NO: 4117 - protein, 11 aa, Artificial Sequence [sequence omitted]

SEQ ID NO: 4118 - protein, 11 aa, Artificial Sequence
  Made in Lab - CRDL3 from anti-Fzd VL chain
CQQAYSFPWTF

SEQ ID NO: 4119 - protein, 11 aa, Artificial Sequence [sequence omitted]

SEQ ID NO: 4120 - protein, 11 aa, Artificial Sequence [sequence omitted]

SEQ ID NO: 4121 - protein, 11 aa, Artificial Sequence [sequence omitted]

SEQ ID NO: 4122 - protein, 11 aa, Artificial Sequence [sequence omitted]

SEQ ID NO: 4123 - protein, 11 aa, Artificial Sequence [sequence omitted]

SEQ ID NO: 4124 - protein, 11 aa, Artificial Sequence [sequence omitted]

SEQ ID NO: 4125 - protein, 11 aa, Artificial Sequence [sequence omitted]

SEQ ID NO: 4126 - protein, 11 aa, Artificial Sequence [sequence omitted]

SEQ ID NO: 4127 - protein, 11 aa, Artificial Sequence [sequence omitted]

SEQ ID NO: 4128 - protein, 11 aa, Artificial Sequence [sequence omitted]

SEQ ID NO: 4129 - protein, 11 aa, Artificial Sequence
  Made in Lab - CRDL3 from anti-Fzd VL chain
CMQGLQPPFTF

SEQ ID NO: 4130 - protein, 11 aa, Artificial Sequence [sequence omitted]

SEQ ID NO: 4131 - protein, 11 aa, Artificial Sequence [sequence omitted]

SEQ ID NO: 4132 - protein, 11 aa, Artificial Sequence [sequence omitted]

SEQ ID NO: 4133 - protein, 11 aa, Artificial Sequence [sequence omitted]

SEQ ID NO: 4134 - protein, 11 aa, Artificial Sequence [sequence omitted]

SEQ ID NO: 4135 - protein, 11 aa, Artificial Sequence [sequence omitted]

SEQ ID NO: 4136 - protein, 11 aa, Artificial Sequence [sequence omitted]

SEQ ID NO: 4137 - protein, 11 aa, Artificial Sequence [sequence omitted]

SEQ ID NO: 4138 - protein, 11 aa, Artificial Sequence [sequence omitted]

SEQ ID NO: 4139 - protein, 11 aa, Artificial Sequence [sequence omitted]

SEQ ID NO: 4140 - protein, 11 aa, Artificial Sequence [sequence omitted]

SEQ ID NO: 4141 - protein, 11 aa, Artificial Sequence [sequence omitted]

SEQ ID NO: 4142 - protein, 11 aa, Artificial Sequence [sequence omitted]

SEQ ID NO: 4143 - protein, 11 aa, Artificial Sequence [sequence omitted]

SEQ ID NO: 4144 - protein, 11 aa, Artificial Sequence
  Made in Lab - CRDL3 from anti-Fzd VL chain
CQQGYNIPFTF

SEQ ID NO: 4145 - protein, 11 aa, Artificial Sequence [sequence omitted]

SEQ ID NO: 4146 - protein, 11 aa, Artificial Sequence
  Made in Lab - CRDL3 from anti-Fzd VL chain
CMQGLQTPWAF

SEQ ID NO: 4147 - protein, 11 aa, Artificial Sequence
  Made in Lab - CRDL3 from anti-Fzd VL chain
CQQAYGFPPTF

SEQ ID NO: 4148 - protein, 11 aa, Artificial Sequence [sequence omitted]

SEQ ID NO: 4149 - protein, 11 aa, Artificial Sequence
  Made in Lab - CRDL3 from anti-Fzd VL chain
CMQGLEAPITF

SEQ ID NO: 4150 - protein, 11 aa, Artificial Sequence [sequence omitted]

SEQ ID NO: 4151 - protein, 11 aa, Artificial Sequence [sequence omitted]

SEQ ID NO: 4152 - protein, 11 aa, Artificial Sequence [sequence omitted]

SEQ ID NO: 4153 - protein, 10 aa, Artificial Sequence [sequence omitted]

SEQ ID NO: 4154 - protein, 11 aa, Artificial Sequence [sequence omitted]

SEQ ID NO: 4155 - protein, 10 aa, Artificial Sequence
  Made in Lab - CRDL3 from anti-Fzd VL chain
CQQYYSDPTF

SEQ ID NO: 4156 - protein, 11 aa, Artificial Sequence [sequence omitted]

SEQ ID NO: 4157 - protein, 11 aa, Artificial Sequence [sequence omitted]

SEQ ID NO: 4158 - protein, 11 aa, Artificial Sequence [sequence omitted]

SEQ ID NO: 4159 - protein, 11 aa, Artificial Sequence [sequence omitted]

SEQ ID NO: 4160 - protein, 11 aa, Artificial Sequence [sequence omitted]

SEQ ID NO: 4161 - protein, 11 aa, Artificial Sequence [sequence omitted]

SEQ ID NO: 4162 - protein, 11 aa, Artificial Sequence [sequence omitted]

SEQ ID NO: 4163 - protein, 11 aa, Artificial Sequence [sequence omitted]

SEQ ID NO: 4164 - protein, 11 aa, Artificial Sequence [sequence omitted]

SEQ ID NO: 4165 - protein, 11 aa, Artificial Sequence [sequence omitted]

SEQ ID NO: 4166 - protein, 11 aa, Artificial Sequence
  Made in Lab - CRDL3 from anti-Fzd VL chain
CQQANNYPITF

SEQ ID NO: 4167 - protein, 11 aa, Artificial Sequence [sequence omitted]

SEQ ID NO: 4168 - protein, 11 aa, Artificial Sequence [sequence omitted]

SEQ ID NO: 4169 - protein, 11 aa, Artificial Sequence [sequence omitted]

SEQ ID NO: 4170 - protein, 11 aa, Artificial Sequence [sequence omitted]

SEQ ID NO: 4171 - protein, 10 aa, Artificial Sequence [sequence omitted]

SEQ ID NO: 4172 - protein, 11 aa, Artificial Sequence [sequence omitted]

SEQ ID NO: 4173 - protein, 11 aa, Artificial Sequence [sequence omitted]

SEQ ID NO: 4174 - protein, 11 aa, Artificial Sequence [sequence omitted]

SEQ ID NO: 4175 - protein, 11 aa, Artificial Sequence [sequence omitted]

SEQ ID NO: 4176 - protein, 11 aa, Artificial Sequence [sequence omitted]

SEQ ID NO: 4177 - protein, 11 aa, Artificial Sequence [sequence omitted]

SEQ ID NO: 4178 - protein, 11 aa, Artificial Sequence
  Made in Lab - CRDL3 from anti-Fzd VL chain
CQQSYDIPITF

SEQ ID NO: 4179 - protein, 11 aa, Artificial Sequence [sequence omitted]

SEQ ID NO: 4180 - protein, 11 aa, Artificial Sequence [sequence omitted]

SEQ ID NO: 4181 - protein, 11 aa, Artificial Sequence [sequence omitted]

SEQ ID NO: 4182 - protein, 11 aa, Artificial Sequence [sequence omitted]

SEQ ID NO: 4183 - protein, 11 aa, Artificial Sequence [sequence omitted]

SEQ ID NO: 4184 - protein, 11 aa, Artificial Sequence
  Made in Lab - CRDL3 from anti-Fzd VL chain
CQQYAASPSSF

SEQ ID NO: 4185 - protein, 11 aa, Artificial Sequence
  Made in Lab - CRDL3 from anti-Fzd VL chain
CMQALEAPITF

SEQ ID NO: 4186 - protein, 11 aa, Artificial Sequence [sequence omitted]

SEQ ID NO: 4187 - protein, 11 aa, Artificial Sequence [sequence omitted]

SEQ ID NO: 4188 - protein, 11 aa, Artificial Sequence
  Made in Lab - CRDL3 from anti-Fzd VL chain
CQQTYTIPITF

SEQ ID NO: 4189 - protein, 11 aa, Artificial Sequence [sequence omitted]

SEQ ID NO: 4190 - protein, 11 aa, Artificial Sequence [sequence omitted]

SEQ ID NO: 4191 - protein, 11 aa, Artificial Sequence
  Made in Lab - CRDL3 from anti-Fzd VL chain
CQQGYNIPFTF

SEQ ID NO: 4192 - protein, 11 aa, Artificial Sequence
  Made in Lab - CRDL3 from anti-Fzd VL chain
CLQHKKYPLTF

SEQ ID NO: 4193 - protein, 11 aa, Artificial Sequence [sequence omitted]

SEQ ID NO: 4194 - protein, 11 aa, Artificial Sequence [sequence omitted]

SEQ ID NO: 4195 - protein, 11 aa, Artificial Sequence [sequence omitted]

SEQ ID NO: 4196 - protein, 11 aa, Artificial Sequence [sequence omitted]

SEQ ID NO: 4197 - protein, 11 aa, Artificial Sequence [sequence omitted]

SEQ ID NO: 4198 - protein, 11 aa, Artificial Sequence [sequence omitted]

SEQ ID NO: 4199 - protein, 11 aa, Artificial Sequence
  Made in Lab - CRDL3 from anti-Fzd VL chain
CQHYAASPSSF

SEQ ID NO: 4200 - protein, 11 aa, Artificial Sequence [sequence omitted]

SEQ ID NO: 4201 - protein, 11 aa, Artificial Sequence [sequence omitted]

SEQ ID NO: 4202 - protein, 11 aa, Artificial Sequence [sequence omitted]

SEQ ID NO: 4203 - protein, 11 aa, Artificial Sequence [sequence omitted]

What is claimed is:

1. An isolated antibody, or an antigen-binding fragment thereof, that binds to Frizzled 1 (Fzd1), comprising a sequence comprising:
   (i) CDRH1 of SEQ ID NO: 51, CDRH2 of SEQ ID NO: 747 and CDRH3 of SEQ ID NO: 1443; and
   (ii) CDRL1 of SEQ ID NO: 2139, CDRL2 of SEQ ID NO: 2833 and CDRL3 of SEQ ID NO: 3527.

2. The isolated antibody, or antigen-binding fragment thereof, of claim 1, wherein the antibody, or antigen-binding fragment thereof, is humanized.

3. The isolated antibody, or antigen-binding fragment thereof, of claim 1, wherein the antibody, or antigen-binding fragment thereof, is a Fab or a Fab' fragment.

4. The isolated antibody, or antigen-binding fragment thereof, of claim 1, wherein the antibody, or antigen-binding fragment thereof, is a fusion protein.

5. The isolated antibody, or antigen-binding fragment thereof, of claim 4, wherein the antibody, or antigen-binding fragment thereof, is fused to a polypeptide sequence that binds LRP5 or LRP6.

6. The isolated antibody or antigen binding fragment of claim 1, comprising:
   a) a variable light chain having at least 90% sequence identity to SEQ ID NO: 22; and
   b) a variable heavy chain having at least 90% sequence identity to SEQ ID NO: 1523.

7. The isolated antibody, or antigen-binding fragment thereof, of claim 1, which modulates a Wnt signaling pathway in a cell, optionally a mammalian cell.

8. A pharmaceutical composition comprising a physiologically acceptable excipient, diluent, or carrier, and a therapeutically effective amount of the isolated antibody, or antigen-binding fragment thereof, according to claim 1.

9. A method for agonizing a Wnt signaling pathway in a cell, comprising contacting the cell with the isolated antibody, or antigen-binding fragment thereof, according to claim 7.

10. The isolated antibody or antigen binding fragment thereof of claim 6, comprising:
   a) a polypeptide comprising SEQ ID NO: 22; and
   b) a polypeptide comprising SEQ ID NO: 23.

* * * * *